US007655245B2

(12) United States Patent
Scarlato et al.

(10) Patent No.: US 7,655,245 B2
(45) Date of Patent: Feb. 2, 2010

(54) NEISSERIAL ANTIGENS

(75) Inventors: Vincenzo Scarlato, Siena (IT); Vega Masignani, Siena (IT); Rino Rappuoli, Siena (IT); Mariagrazia Pizza, Siena (IT); Guido Grandi, Siena (IT)

(73) Assignee: Novartis AG, Basel (CH)

( * ) Notice: Subject to any disclaimer, the term of this patent is extended or adjusted under 35 U.S.C. 154(b) by 826 days.

(21) Appl. No.: 10/864,684

(22) Filed: Jun. 8, 2004

(65) Prior Publication Data

US 2008/0131421 A1 Jun. 5, 2008

Related U.S. Application Data

(63) Continuation of application No. 09/303,518, filed on Apr. 30, 1999, now Pat. No. 6,914,131, which is a continuation-in-part of application No. PCT/IB98/01665, filed on Oct. 9, 1998.

(30) Foreign Application Priority Data

| Nov. 6, 1997 | (GB) | .................. 19970023516 |
| Nov. 14, 1997 | (GB) | .................. 19970024190 |
| Nov. 18, 1997 | (GB) | .................. 19970024386 |
| Nov. 27, 1997 | (GB) | .................. 19970025158 |
| Dec. 10, 1997 | (GB) | .................. 19970026147 |
| Jan. 14, 1998 | (GB) | .................. 19980000759 |
| Sep. 1, 1998 | (GB) | .................. 19980019016 |

(51) Int. Cl.
*A61K 39/095* (2006.01)
*C07K 14/195* (2006.01)
*C12P 21/04* (2006.01)
*C07H 21/04* (2006.01)

(52) U.S. Cl. ............ 424/250.1; 424/249.1; 424/234.1; 424/190.1; 435/69.1; 435/69.7; 435/252.3; 530/350; 536/23.1; 536/23.7

(58) Field of Classification Search .................. None
See application file for complete search history.

(56) References Cited

U.S. PATENT DOCUMENTS

| 5,288,641 A | 2/1994 | Roizman |
| 5,422,120 A | 6/1995 | Kim |
| 5,580,859 A | 12/1996 | Felgner et al. |
| 5,591,624 A | 1/1997 | Barber et al. |
| 5,763,188 A | 6/1998 | Ohno et al. |
| 5,785,974 A | 7/1998 | Casal Alvarez et al. |
| 6,100,380 A | 8/2000 | Green et al. |
| 6,127,180 A | 10/2000 | Narva et al. |
| 6,150,502 A | 11/2000 | Strachan et al. |
| 6,583,275 B1 | 6/2003 | Doucette-Stamm et al. |
| 6,914,131 B1 | 7/2005 | Scarlato et al. |

FOREIGN PATENT DOCUMENTS

| EP | 0 176 170 | 4/1986 |
| EP | 0 334 301 | 9/1989 |
| EP | 0 345 242 | 12/1989 |
| EP | 0 415 731 | 3/1991 |
| GB | 2 200 651 | 8/1988 |
| WO | WO 90/11092 | 10/1990 |
| WO | WO 92/05266 | 4/1992 |
| WO | WO 93/06223 | 4/1993 |
| WO | WO 93/07282 | 4/1993 |
| WO | WO 93/07283 | 4/1993 |
| WO | WO 93/14778 | 8/1993 |
| WO | WO-9318150 | 9/1993 |
| WO | WO 95/13796 | 5/1995 |
| WO | WO 95/30763 | 11/1995 |
| WO | WO-9605858 | 2/1996 |
| WO | WO-9612020 | 4/1996 |
| WO | WO 96/29412 | 9/1996 |
| WO | WO-9631618 | 10/1996 |
| WO | WO-9711181 | 3/1997 |
| WO | WO 98/20734 | 5/1998 |
| WO | WO-9924578 | 5/1999 |
| WO | WO-9955873 | 11/1999 |
| WO | WO-9957280 | 11/1999 |

OTHER PUBLICATIONS

Gomez et al. Vaccine 14: 1340-1346, 1996.*
Teerlink et al. J. Exp. Med. 166: 63-76, 1987 (Abstract Only).*
Forest et al. Gene 192: 165-169, 1997.*
Ala'Aldeen et al. Vaccine 12: 535-541, 1994(Abstract Only).*
Houghten et al. (Vaccines, 1986, Edited by Fred Brown: Cold Spring Harbor Laboratory).*
Lederman et al (Molecular Immunology 28:1171-1181, 1991).*
Li et al (Proc. Natl. Acad. Sci. USA 77:3211-3214, 1980).*
Page 46 of Cruse et al., Illustrated Dictionary of Immunology, 2nd Edn., CRC Press, 2003.*
Poulsen et al, Infect. Immun. 57, 3097-3105, 1989.*
Pohlner et al, Nature 325, 458-462, 1987 (Abstract Only).*
Ala'Aldeen et al., The Meningococcal Transferrin-Binding Proteins 1 and 2 Are Both Surface Exposed and Generate Bactericidal Antibodies Capable of Killing Homologous and Heterologous Strains, *Vaccine* 14(1): 49-53 (1996).
Altschul et al., Gapped Blast and PSI-Blast: A New Generation of Protein Database Search Programs, *Nucl. Acids Res.*, 25: 2289-3402 (1997).
Berkner, Development of Adenovirus Vectors for the Expression of Heterologous Genes, *Biotechniques* 6: 616-629 (1988).
Connelly et al., In Vivo Gene Delivery and Expression of Physiological Levels of Fuctional Human Factor VIII in Mice, *Human Gene Therapy* 6: 185-193 (1995).

(Continued)

*Primary Examiner*—Robert B Mondesi
*Assistant Examiner*—Padma V Baskar
(74) *Attorney, Agent, or Firm*—Amy Hessler; Helen Lee; Robert Gorman

(57) ABSTRACT

The invention provides proteins from *Neisseria meningitidis* (strains A & B) and from *Neisseria gonorrhoeae*, including amino acid sequences, the corresponding nucleotide sequences, expression data, and serological data. The proteins are useful antigens for vaccines, immunogenic compositions, and/or diagnostics.

3 Claims, 24 Drawing Sheets

OTHER PUBLICATIONS

Costantino et al., Development and Phase I Clinical Testing of a Conjugate Vaccine Against Meningococcus A and C, *Vaccine* 10: 691-698 (1992).

Donnelly et al., DNA Vaccines, *Annu. Rev. Immunol.* 15: 617-648 (1997).

Esposti e al., Critical Evaluation of the Hydropathy of Membrane Proteins, *Eur. J. Biochem.* 190:207-219 (1990).

Gao et al., Indentification and Characterization of T Helper Epitopes in the Nucleoprotein of Influenza A Virus, *J. Immunol.* 143: 3007-3014 (1989).

Jolly, Viral Vector Systems for Gene Therapy, *Cancer Gene Therapy* 1:51-64 (1994).

Kimura et al., Retroviral Delivery of DNA Into the Livers of Transgenic Mice Bearing Premalignant and Malignant Hepatocellular Carcinomas, *Human Gene Therapy* 5:845-852 (1994).

Kohler et al., Continuous Cultures of Fused Cells Secreting Antibody of Predefined Specificity, *Nature* 256: 495-496, 1975.

Lieberman et al., Safety and Immunogenicity of a Serogroups A/C *Neisseria meningitidis* Oligosaccharide-Protein Conjugate Vaccine in Young Children, *JAMA* 275(19): 1499-1503.

Morbidity and Mortality weekly report, Control and Prevention of Meningococcal Disease: Recommendations of the Advisory Committee on Immunization PRA, May 27, 2005.

Poolman, J.T. Development of a Meningococcal Vaccine, *Infect. Agents Dis.*, 4:13-28 (1992).

Quakyi et al., Development of a Malaria T-Cell Vaccine for Blood Stage Immunity, *Scand. J. Immunol*, Suppl. 11: 9-16 (1992).

Roberts et al., Prediction of HIV Peptide Epitopes by a Novel Algorithm, *AIDS Res. Hum. Retrovir.*, 12: 593-610 (1996).

Robinson et al., DNA Vaccines, *Seminars in Immunology*, 9: 271-283 (1997).

Romero et al., Current Status of Meningococcal Group B Vaccine Candidates: Capsular or Noncapsular?, *Clin. Microbiol. Rev.* 7(4): 559-575 (1994).

Rosenfeld et al., Adenovirus-Mediated Transfer of a Recombinant αL-Antitrypsin Gene to the Lung Epithelium In Vivo, *Science* 252: 431-434 (1991).

Schuchat et al., Bacterial Meningitis in the United States in 1995, *N. Engl. J. Med.* 337(14): 970-976 (1997).

Szoka et al., Procedure for Preparation of Liposomes With Large Internal Aqueous Space and High Capture by Reverse-Phase Evaporation, *Proc. Natl. Acad. Sci. USA* 75: 4194-4198 (1978).

Wedege, et al., Human Anitbody Response to a Group B Serotype 2A Meningococcal Vaccine Determined by Immunoblotting, *Infection & Immunity*, 51(2): 571-578 (1986).

Zollinger, New and Improved Vaccines Against Meningococcal Disease, *New Generation vaccines*, 2nd ed., Levine, et al. (eds.) Marcel Dekker, New York, 1997, 469-488.

Accession No. A61824 from PCT Patent Publication No. WO 97/11181. Created Mar. 9, 1998. (2 pages).

GenBank Accession No. A61829, last updated Mar. 9, 1998, located at <http://www.ncbi.nlm.nih.gov/entrez/viewer.fcgi?db=nuccore&id=3715998>, last visited on Nov. 20, 2008, 2 pages.

GenBank Accession No. AJ001740, last updated May 21, 1998, located at <http://www.ncbi.nlm.nih.gov/entrez/viewer.fcgi?db=nuccore&id=3152399>, last visited on Nov. 20, 2008, 2 pages.

GenBank Accession No. HIU20229, last updated Feb. 9, 1995, located at <http://www.ncbi.nlm.nih.gov/entrez/viewer.fcgi?db=nuccore&id=644850>, last visited on Nov. 20, 2008, 5 pages.

UniProtKB/TrEMBL Accession No. Q9X7H1, last updated Feb. 10, 2009, located at <http://www.uniprot.org/uniprot/Q9X7H1.txt> visited on May 12, 2009. (2 pages).

European Examination Report dated Nov. 20, 2008 for EP application No. 98 946 675.0. 3 pages.

European Examination Report dated Jun. 23, 2005 for EP application No. 98 946 675.0. 3 pages.

European Search Opinion and Partial European Search Report mailed Feb. 27, 2007, for EP Application 06076711.8 filed May 19, 2000, 16 pages.

Opposition to European Patent No. 1194560 B1, granted on Jul. 4, 2007 in the name of Novartis Vaccines and Diagnostics S.r.l.. Opposition filed by GlaxoSmithKline Biologicals S.A. On Apr. 4, 2008.

International Search Report mailed Dec. 8, 1999, for International Application No. PCT/IB98/01665, filed Oct. 9, 1998.

Berzofsky, J. A. (1985). "Intrinsic and Extrinsic Factors in Protein Antigenic Structure," *Science* 229(4717):932-940.

Harlow et al. (1988). *Antibodies, A Laboratory Manual*. Cold Spring Harbor Laboratory, Chapter 5, p. 76.

Martin et al. (1997). "Highly Conserved *Neisseria meningitidis* Surface Protein Confers Protection against Experimental Infection," J. Exp. Med. 185(7):1173-1183.

Morris et al. (1994). "Nucleotide Sequence Analysis and Potential Environmental Distribution of a Ferric Pseudobactin Receptor Gene of *Pseudomonas* sp. Strain M114," Molecular and General Genetics 242:9-16.

Nassif et al. (1997). "Type-4 pili and meningococcal adhesiveness," Gene 192:149-153.

Paruchuri et al. (Jan. 1990). "Identification and Characterization of a *Neisseria gonorrhoea* Gene e Encoding a Glycolipid-binding Adhesion," *Proceedings of the National Academy of Sciences USA* 87:333-337.

Rokbi et al. (1997) "Evaluation of Recombinant Transferrin-Binding Protein B Variants from *Neisseria meningitidis* for Their Ability To Induce Cross-Reactive and Bactericidal Antibodies against a Genetically Diverse Collection of Serogroup B Strains," *Infection and Immunity* 65(1):55-63.

Rudel et al. (1995). "*Neisseria* PilC protein identified as type-4 pilus tip-located adhesin," Nature 373:357-359.

Schryvers et al. (1999). "Iron Acquisition Systems in the Pathogenic *Neisseria*," Molecular Microbiology 32(6)1117-1123.

Sepulvada et al. (1975). "Primary Structure of Porcine Pepsin," Journal of Biological Chemistry, 250(13):5082-5088.

St. Geme III et al. (1994). "A *Haemophilus influenzae* IgA Protease-like Protein Promotes Intimate Interaction with Human Epithelial Cells," Molecular Microbiology 14(2):217-233.

Sutcliffe et al. (1983). "Antibodies That React with Predetermined Sites on Proteins," Science 219(4585):660-666.

Tettelin et al. (2000). "Complete Genome Sequence of *Neisseria meningitidis* Serogroup B Strain MC58," Science 287:1809-1815.

Tettelin et al. (2000). "Hypothetical protein (*Neisseria meningitidis* serogroup B)," Database GENSEQ (Online), Accession No. Q9K0G2.

Tettelin et al. (2000). "TonB-dependent receptor (*Neisseria meningitidis* serogroup B)," Database GENSEQ (Online), Accession No. Q9JXU3.

Tettelin et al. (2000). "Hypothetical protein (*Neisseria meningitidis* serogroup B)," Database GENSEQ (Online), Accession No. Q9K0Y5.

Yumoto et al. (1996). "Cloning, sequencing and expression of an *Eikenella corrodens* gene encoding a component protein of the lectin-like adhesin complex," Gene 183(1-2): 115-121.

* cited by examiner

FIGURE 1
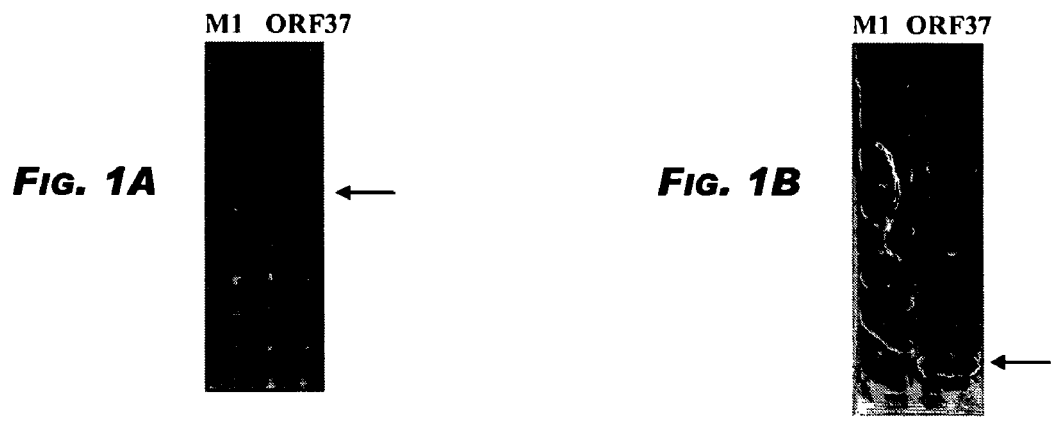
FIG. 1A    FIG. 1B
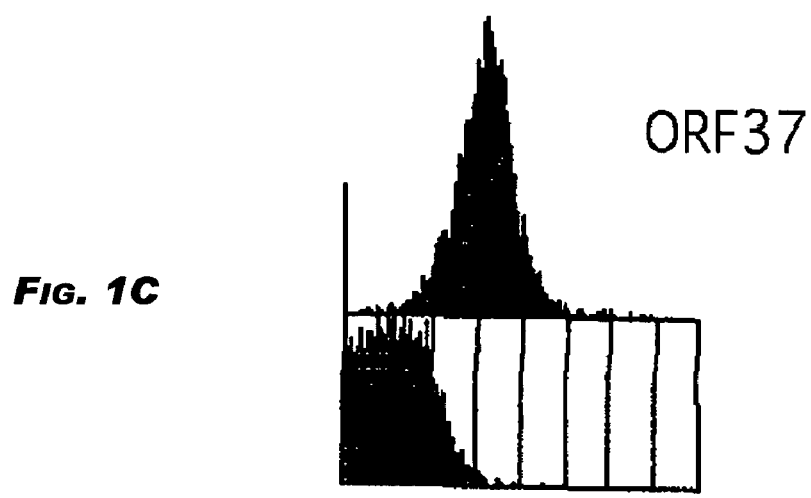
FIG. 1C
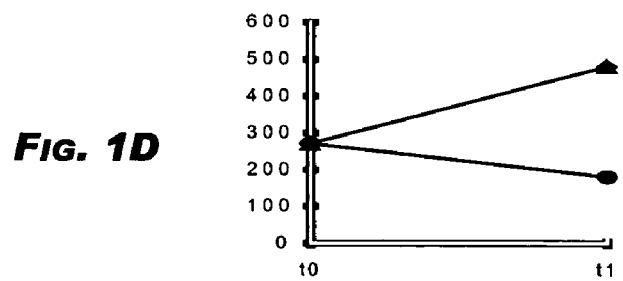
FIG. 1D

FIGURE 2
FIG. 2A
M1  ORF5
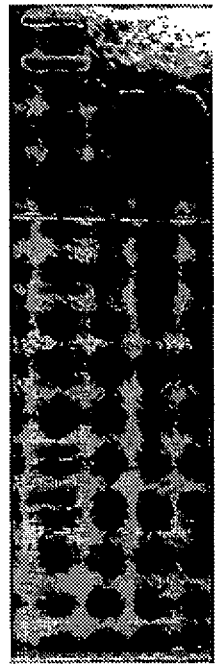
FIG. 2B
TP

FIGURE 3
FIG. 3A
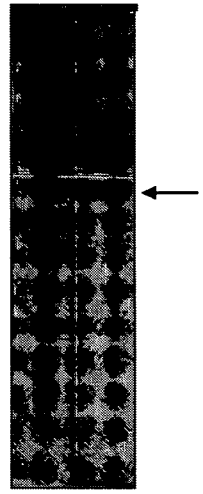
FIG. 3B
FIG. 3C
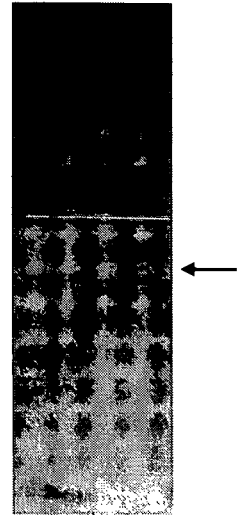
FIG. 3D
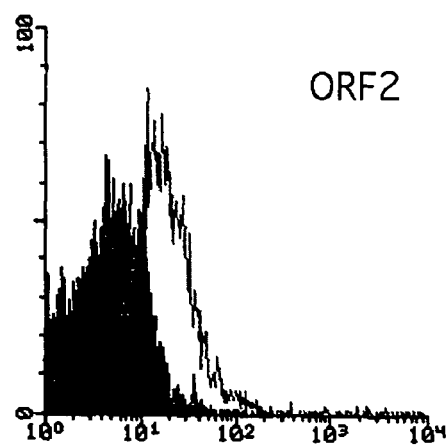

FIGURE 4
FIG. 4A
M1  ORF15
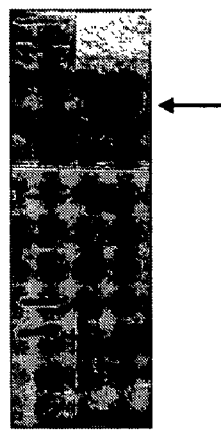
FIG. 4B
M2  ORF15
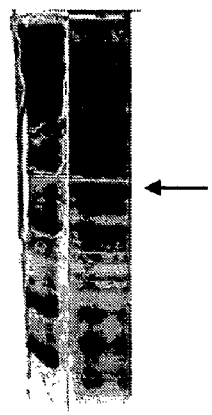
FIG 4C
TP  OMV
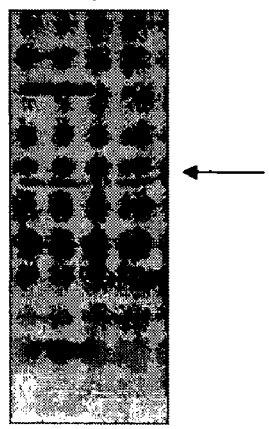

FIGURE 5
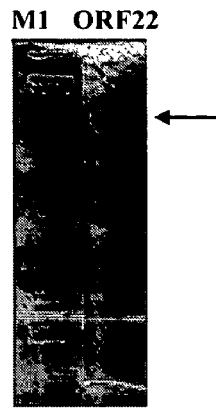
FIG. 5A
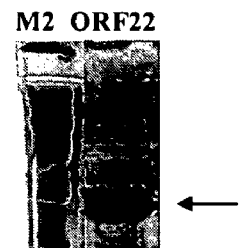
FIG. 5B
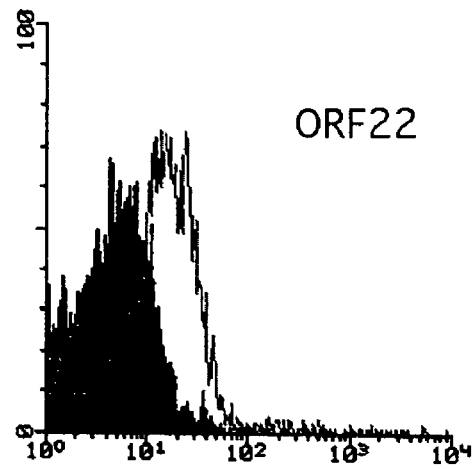
FIG. 5C

FIGURE 6
FIG. 6A
M1  ORF28
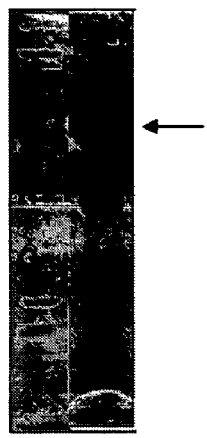
FIG. 6B
M2  ORF28
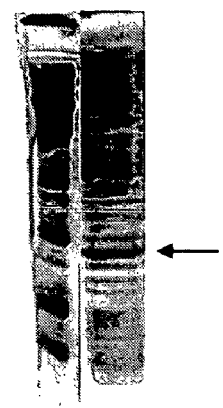
FIGURE 7
FIG. 7A
M1  ORF32
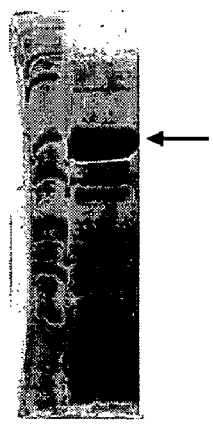
FIG. 7B
M1  ORF32
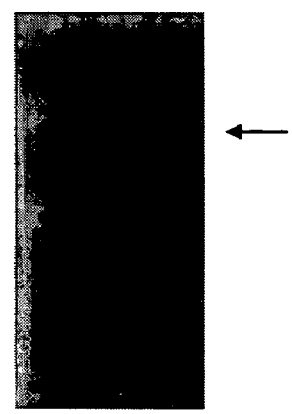

FIGURE 8
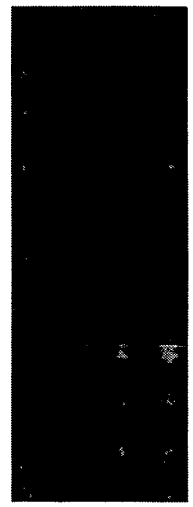
FIG. 8A
FIG. 8B
FIG. 8C
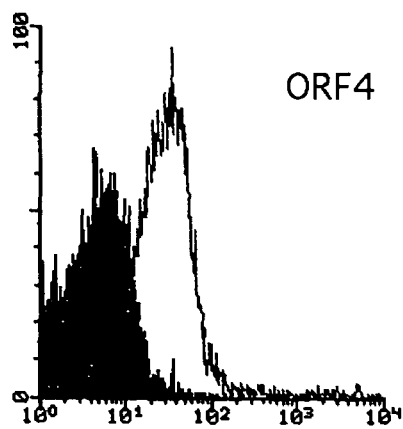
FIG. 8D

FIGURE 10
FIG. 10A
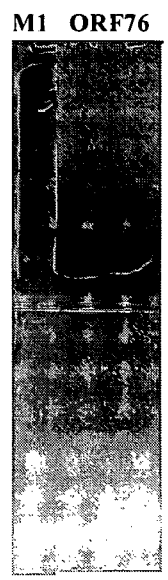
FIG. 10B
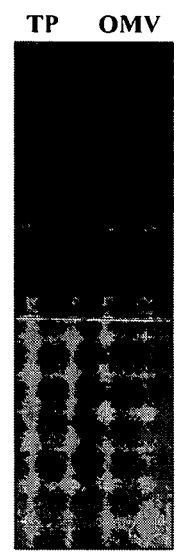
FIG. 10C
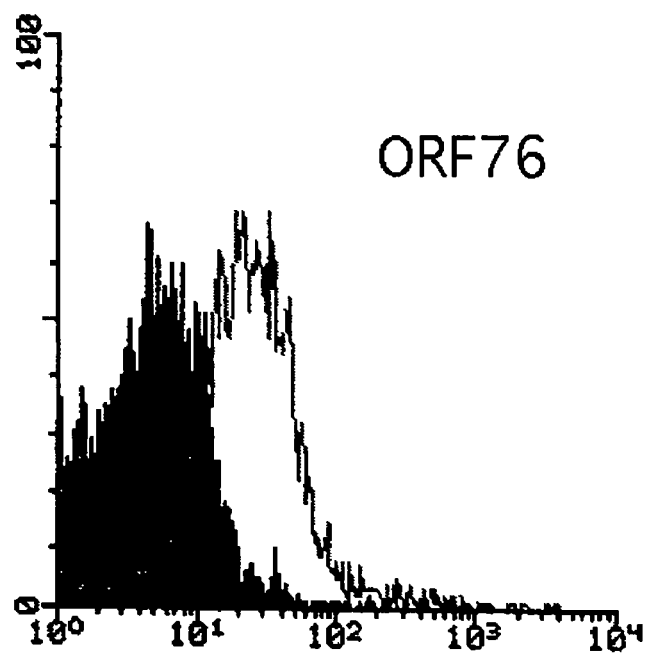

FIG. 12A  FIG. 12B  FIG. 12C

FIGURE 13
FIG. 13A
M1  ORF106
FIG. 13B
M2  ORF106
FIG. 13C
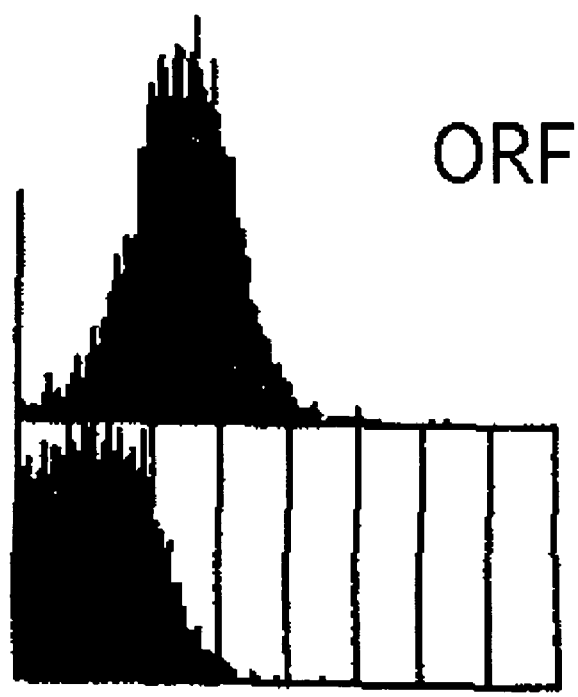
ORF 106

FIGURE 14
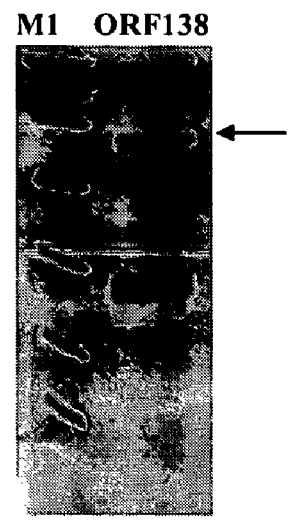
FIG. 14A
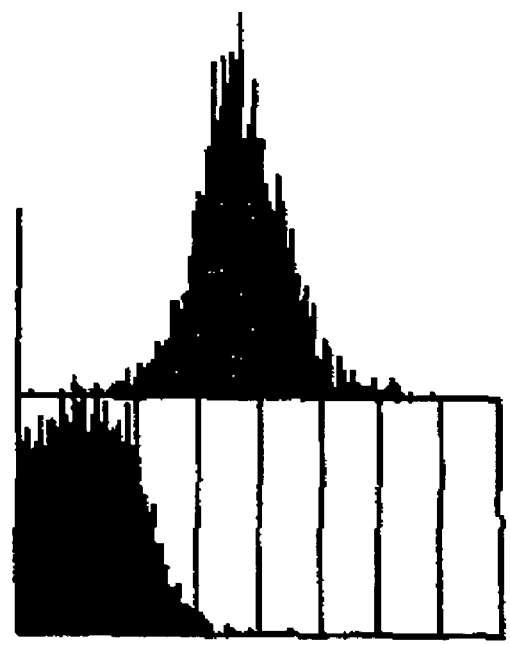
FIG. 14B

FIGURE 15
FIG. 15A
M1  ORF23
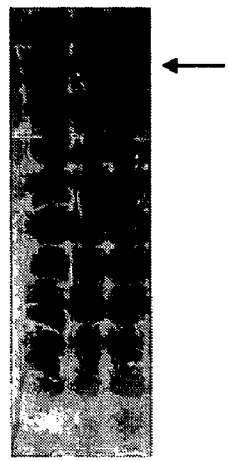
FIG. 15B
M2  ORF23
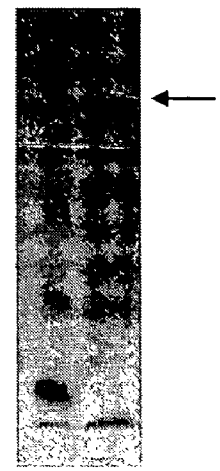
FIG 15C
TP  OMV
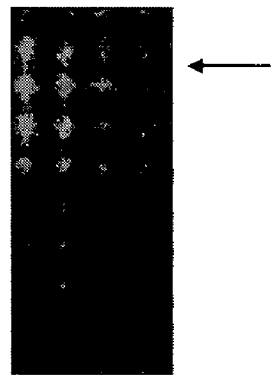

FIGURE 16
FIG. 16A
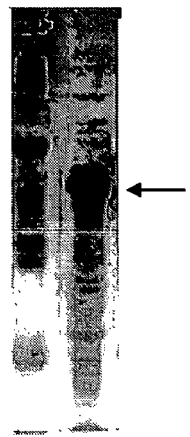
FIG. 16B
FIG. 16C
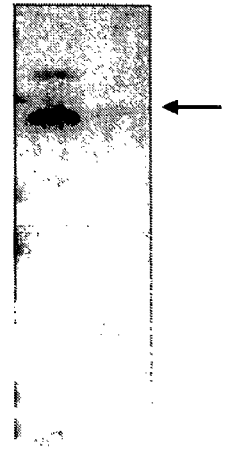
FIG. 16D
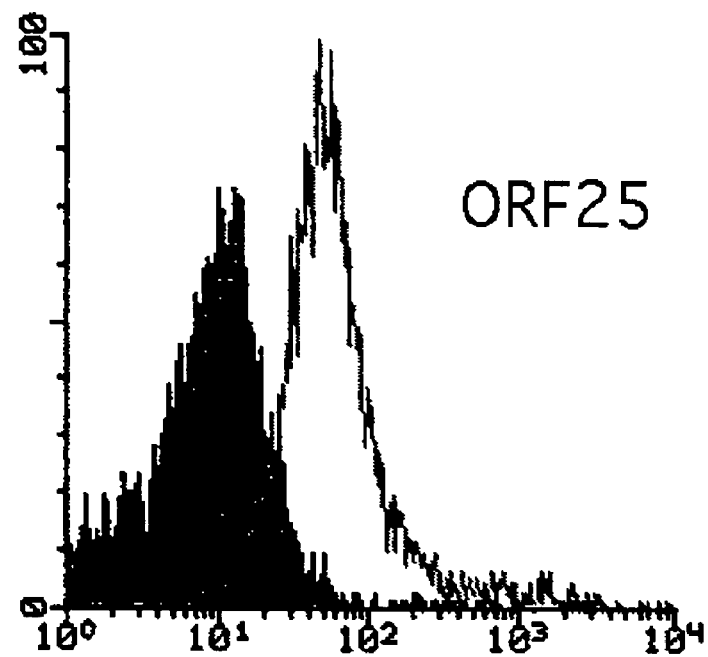

FIGURE 17
FIG. 17A
M1  ORF27
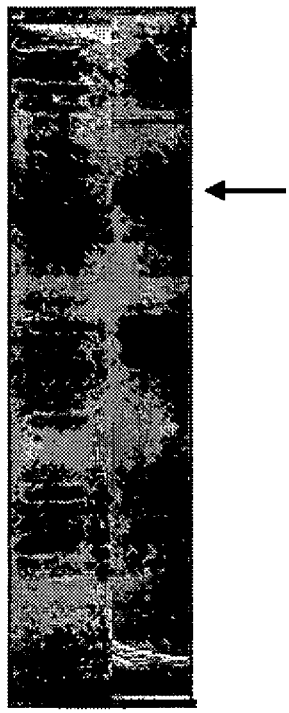
FIG. 17B
M2  ORF27
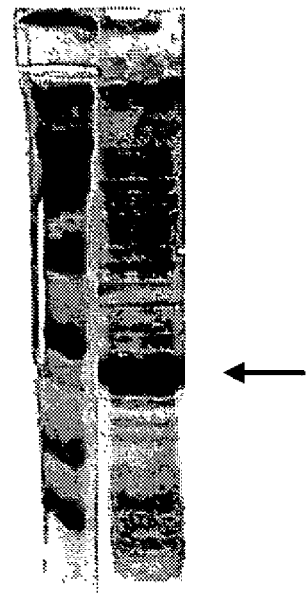

FIGURE 18
FIG. 18A
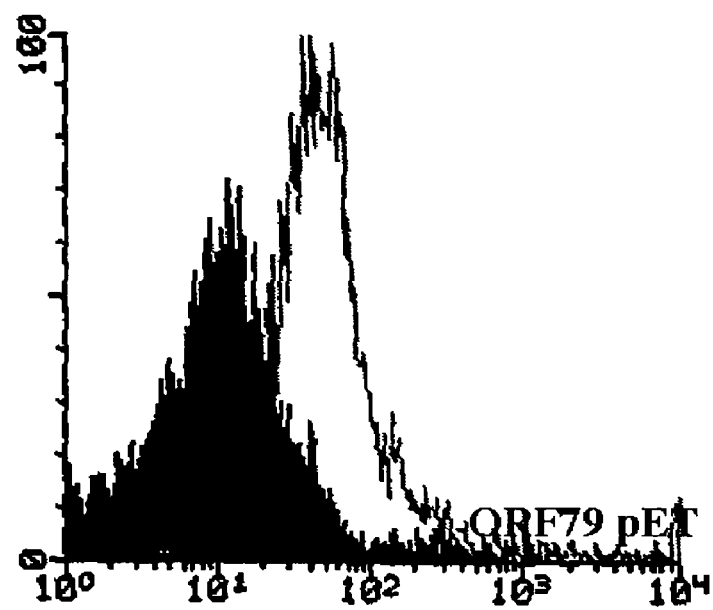
FIG. 18B

FIGURE 19
FIG. 19A
FIG. 19B
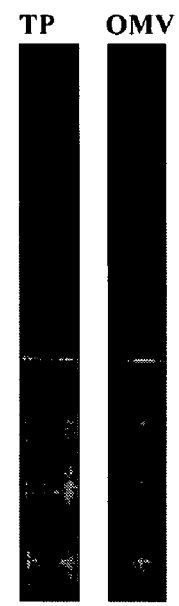
FIG. 19C
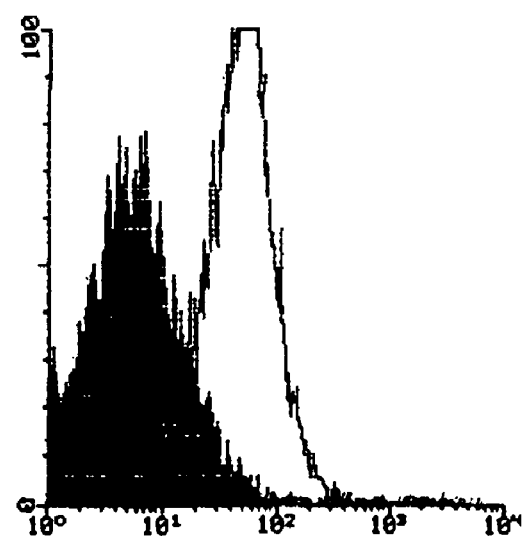

FIGURE 20
FIG. 20A
M1  ORF132
FIG. 20B
M2  ORF132
FIG. 20C
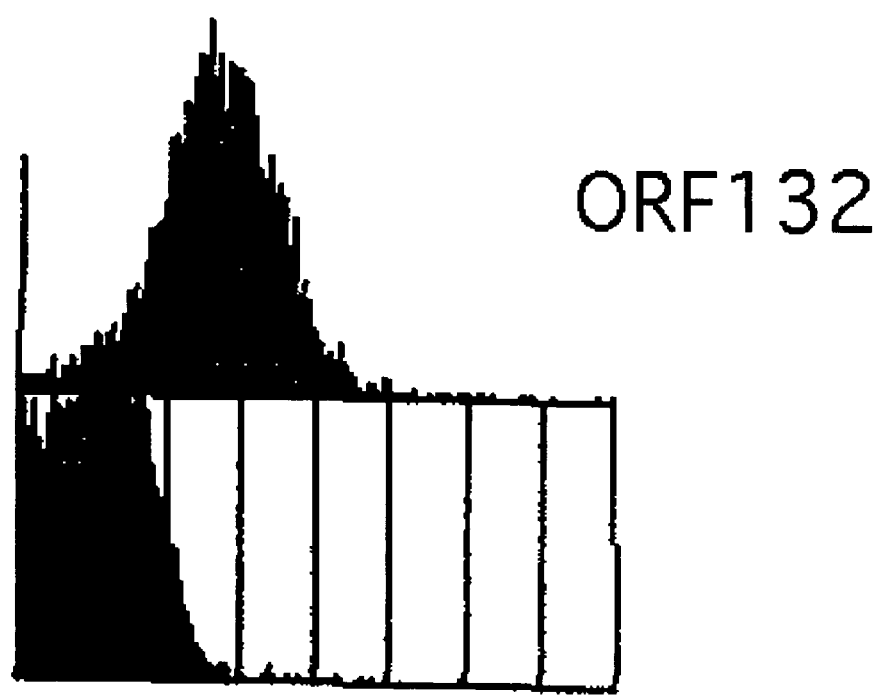

NEISSERIAL ANTIGENS

This application is a continuation application of U.S. patent application Ser. No. 09/303,518, filed Apr. 30, 1999, now U.S. Pat. No. 6,914,131, which is a continuation-in-part of International Patent Application PCT/IB98/01665, filed Oct. 9, 1998, from which applications priority is claimed pursuant to 35 U.S.C. § 120. PCT/IB98/01665 claims priority to Great Britain Patent Applications No. GB19970023516, filed Nov. 6, 1997; No. GB19970024190, filed Nov. 14, 1997; No. GB19970024386, filed Nov. 18, 1997; No. GB19970025158, filed Nov. 27, 1997; No. GB19970026147, filed Dec. 10, 1997; No. GB19980000759, filed Jan. 14, 1998; No. GB19980019016, filed Sep. 1, 1998. All of the above applications are incorporated herein by reference in their entirety.

This invention relates to antigens from *Neisseria* bacteria.

BACKGROUND ART

*Neisseria meningitidis* and *Neisseria gonorrhoeae* are non-motile, gram negative diplococci that are pathogenic in humans. *N. meningitidis* colonises the pharynx and causes meningitis (and, occasionally, septicaemia in the absence of meningitis); *N. gonorrhoeae* colonises the genital tract and causes gonorrhea. Although colonising different areas of the body and causing completely different diseases, the two pathogens are closely related, although one feature that clearly differentiates meningococcus from gonococcus is the presence of a polysaccharide capsule that is present in all pathogenic meningococci.

*N. gonorrhoeae* caused approximately 800,000 cases per year during the period 1983-1990 in the United States alone (chapter by Meitzner & Cohen, "Vaccines Against Gonococcal Infection", In: *New Generation Vaccines,* 2nd edition, ed. Levine, Woodrow, Kaper, & Cobon, Marcel Dekker, New York, 1997, pp. 817-842). The disease causes significant morbidity but limited mortality. Vaccination against *N. gonorrhoeae* would be highly desirable, but repeated attempts have failed. The main candidate antigens for this vaccine are surface-exposed proteins such as pili, porins, opacity-associated proteins (Opas) and other surface-exposed proteins such as the Lip, Laz, IgA1 protease and transferrin-binding proteins. The lipooligosaccharide (LOS) has also been suggested as vaccine (Meitzner & Cohen, supra).

*N. meningitidis* causes both endemic and epidemic disease. In the United States the attack rate is 0.6-1 per 100,000 persons per year, and it can be much greater during outbreaks (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) Bacterial Meningitis in the United States in 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae, N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [e.g. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease" in: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B remains a problem, however. This serotype currently is responsible for approximately 50% of total meningitis in the United States, Europe, and South America. The polysaccharide approach cannot be used because the menB capsular polysaccharide is a polymer of $\alpha$(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (e.g. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala' Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic *Neisseriae*.

THE INVENTION

The invention provides proteins comprising the Neisserial amino acid sequences disclosed in the examples. These sequences relate to *N. meningitidis* or *N. gonorrhoeae*.

It also provides proteins comprising sequences homologous (ie. having sequence identity) to the Neisserial amino acid sequences disclosed in the examples. Depending on the particular sequence, the degree of identity is preferably greater than 50% (eg. 65%, 80%, 90%, or more). These homologous proteins include mutants and allelic variants of the sequences disclosed in the examples. Typically, 50% identity or more between two proteins is considered to be an indication of functional equivalence. Identity between the proteins is preferably determined by the Smith-Waterman homology search algorithm as implemented in the MPSRCH program (Oxford Molecular), using an affine gap search with parameters gap open penalty=12 and gap extension penalty=1.

The invention further provides proteins comprising fragments of the Neisserial amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (ie. substantially free from other Neisserial or host cell proteins)

According to a further aspect, the invention provides antibodies which bind to these proteins. These may be polyclonal or monoclonal and may be produced by any suitable means.

According to a further aspect, the invention provides nucleic acid comprising the Neisserial nucleotide sequences disclosed in the examples. In addition, the invention provides nucleic acid comprising sequences homologous (ie. having sequence identity) to the Neisserial nucleotide sequences disclosed in the examples.

Furthermore, the invention provides nucleic acid which can hybridise to the Neisserial nucleic acid disclosed in the examples, preferably under "high stringency" conditions (eg. 65° C. in a 0.1×SSC, 0.5% SDS solution).

Nucleic acid comprising fragments of these sequences are also provided. These should comprise at least n consecutive nucleotides from the Neisserial sequences and, depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents, or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of: (i) a medicament for treating or preventing infection due to Neisserial bacteria; (ii) a diagnostic reagent for detecting the presence of Neisserial bacteria or of antibodies raised against Neisserial bacteria; and/or (iii) a reagent which can raise antibodies against Neisserial bacteria. Said Neisserial bacteria may be any species or strain (such as *N. gonorrhoeae*, or any strain of *N. meningitidis*, such as strain A, strain B or strain C).

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986);

*Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference. In particular, the contents of UK patent applications 9723516.2, 9724190.5, 9724386.9, 9725158.1, 9726147.3, 9800759.4, and 9819016.8 are incorporated herein.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" eg. a composition "comprising" X may consist exclusively of X or may include something additional to X, such as X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753, 235).

Expression Systems

The Neisserial nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual, 2nd ed.*].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual]*.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replicaton systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.,* 42:177) and a prokaryotic ampicillin-resistance (amp) gene and origin of replication for selection and propagation in *E. coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21].

Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) *J. Biotechnol.* 5:93; Makoff et al. (1989) *J. Gen. Microbiol.* 135: 11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S, Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad. Sci. USA* 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (e.g. WO88/ 024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (e.g. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene* 8:17-24], pCl/1 [Brake et al. (1984) *Proc. Natl. Acad. Sci. USA* 81:4642-4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) *Methods in Enzymol.* 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbiol, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: *Candida albicans* [Kurtz, et al. (1986) *Mol. Cell. Biol.* 6:142], *Candida maltosa* [Kunze, et al. (1985) *J. Basic Microbiol.* 25:141]. *Hansenula polymorpha* [Gleeson, et al. (1986) *J. Gen. Microbiol.* 132:3459; Roggenkamp et al. (1986) *Mol. Gen. Genet.* 202:302], *Kluyveromyces fragilis* [Das, et al. (1984) *J. Bacteriol.* 158:1165], *Kluyveromyces lactis* [De Louvencourt et al. (1983) *J. Bacteriol.* 154:737; Van den Berg et al. (1990) *Bio/Technology* 8:135], *Pichia guillerimondii* [Kunze et al. (1985) *J. Basic Microbiol.* 25:141], *Pichia pastoris* [Cregg, et al. (1985) *Mol. Cell. Biol.* 5:3376; U.S. Pat. Nos. 4,837,148 and 4,929,555], *Saccharomyces cerevisiae* [Hinnen et al. (1978) *Proc. Natl. Acad. Sci. USA* 75:1929; Ito et al. (1983) *J. Bacteriol.* 153:163], *Schizosaccharomyces pombe* [Beach and Nurse (1981) *Nature* 300:706], and *Yarrowia lipolytica* [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying Neisserial proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 µg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg. 1,000 g for 10 minutes). About 20-50 ml per bleed may be obtained from rabbits.

Monoclonal antibodies are prepared using the standard method of Kohler & Milstein [*Nature* (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g. hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners.

Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be employed [eg. Robinson & Torres (1997) Seminars in Immunology 9:271-283; Donnelly et al. (1997) Annu Rev Immunol 15:617-648; see later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) Cancer Gene Therapy 1:51-64; Kimura (1994) Human Gene Therapy 5:845-852; Connelly (1995) Human Gene Therapy 6:185-193; and Kaplitt (1994) Nature Genetics 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) J. Virol. 53:160) polytropic retroviruses eg. MCF and MCF-MLV (see Kelly (1983) J. Virol. 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) J Virol 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405, 712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixunavirus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochen Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (e.g. see WO98/20734), needles, and gene guns or hyposprays. Dosage treatment may be a single dose schedule or a multiple dose schedule.

Methods for the ex vivo delivery and reimplantation of transformed cells into a subject are known in the art and described in e.g. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccarides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA: micromoles lipid), or more of lipid. For a review of the use of liposomes as carriers for delivery of nucleic acids, see, Hug and Sleight (1991) *Biochim. Biophys. Acta*. 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, e.g. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Biriningham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utennann (1984) Hum Genet. 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in Zuckermann et al. PCT/US97/14465.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm = 81 + 16.6(\log_{10} Ci) + 0.4[\%(G+C)] - 0.6(\% \text{formamide}) - 600/n - 1.5(\% \text{mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated e.g. backbone modifications, such as phosphorothioates or methylphosphonates, can be used to increase in vivo half-life, alter RNA affinity, increase nuclease resistance etc. [e.g. see Agrawal & Iyer (1995) *Curr Opin Biotechnol* 6:12-19; Agrawal (1996) *TIBTECH* 14:376-387]; analogues such as peptide nucleic acids may also be used [e.g. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. Nos. 4,683, 195 and 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

BRIEF DESCRIPTION OF THE DRAWINGS

FIGS. 1-20 show biochemical data obtained in the Examples, and also sequence analysis, for ORFs 37, 5, 2, 15, 22, 28, 32, 4, 61, 76, 89, 97, 106, 138, 23, 25, 27, 79, 85 and 132. M1 and M2 are molecular weight markers. Arrows indicate the position of the main recombinant product or, in Western blots, the position of the main *N. meningitidis* immunoreactive band. TP indicates *N. meningitidis* total protein extract; OMV indicates *N. meningitidis* outer membrane vesicle preparation. In bactericidal assay results: a diamond (♦) shows preimmune data; a triangle (▲) shows GST control data; a circle (●) shows data with recombinant *N. meningitidis* protein. Computer analyses show a hydrophilicity plot (upper), an antigenic index plot (middle), and an AMPHI analysis (lower). The AMPHI program has been used to predict T-cell epitopes [Gao et al. (1989) *J. Immunol.* 143:3007; Roberts et al. (1996) *AIDS Res Hum Retrovir* 12:593; Quakyi et al. (1992) *Scand J Immunol* suppl. 11:9) and is available in the Protean package of DNASTAR, Inc. (1228 South Park Street, Madison, Wis. 53715 USA).

EXAMPLES

Figure 1E:
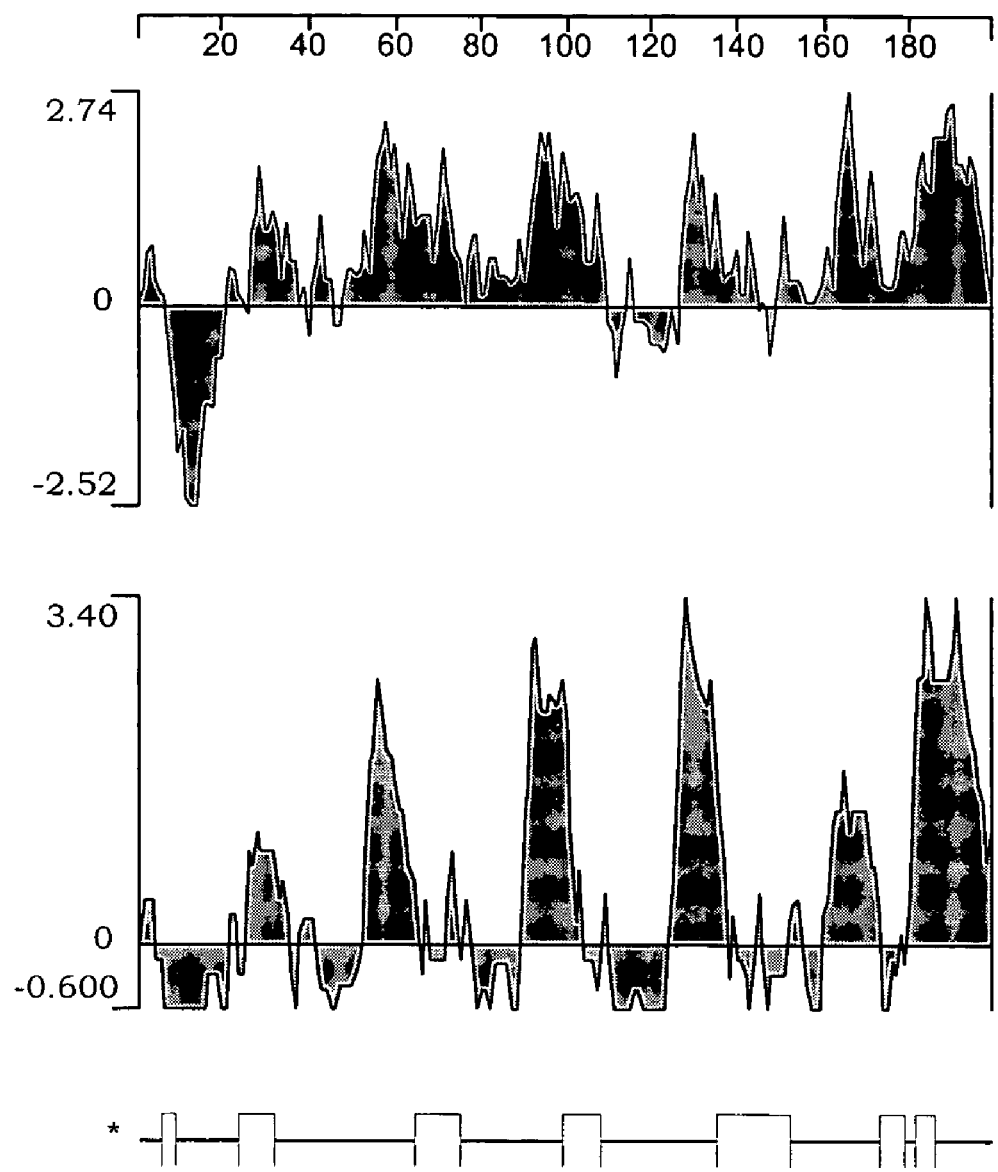

The examples describe nucleic acid sequences which have been identified in *N. meningitidis*, along with their putative translation products, and also those of *N. gonorrhoeae*. Not all of the nucleic acid sequences are complete i.e. they encode less than the full-length wild-type protein.

The examples are generally in the following format:
 a nucleotide sequence which has been identified in *N. meningitidis* (strain B)
 the putative translation product of this sequence
 a computer analysis of the translation product based on database comparisons corresponding gene and protein sequences identified in *N. meningitidis* (strain A) and in *N. gonorrhoeae* a description of the characteristics of the proteins which indicates that they might be suitably antigenic results of biochemical analysis (expression, purification, ELISA, FACS etc.)

The examples typically include details of sequence identity between species and strains. Proteins that are similar in sequence are generally similar in both structure and function, and the sequence identity often indicates a common evolutionary origin. Comparison with sequences of proteins of known function is widely used as a guide for the assignment of putative protein function to a new sequence and has proved particularly useful in whole-genome analyses.

Sequence comparisons were performed at NCBI (http://www.ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SP-update+PIR sequences.

To compare Meningococcal and Gonococcal sequences, the tBLASTx algorithm was used, as implemented at http://www.genome.ou.edu/gono_blast.html. The FASTA algorithm was also used to compare the ORFs (from GCG Wisconsin Package, version 9.0).

Dots within nucleotide sequences (eg. position 495 in SEQ ID 11) represent nucleotides which have been arbitrarily introduced in order to maintain a reading frame. In the same way, double-underlined nucleotides were removed. Lower case letters (eg. position 496 in SEQ ID 11) represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (http://www.psort.nibb.ac.jp). Functional domains were also predicted using the MOTIFS program (GCG Wisconsin & PROSITE).

Various tests can be used to assess the in vivo immunogencity of the proteins identified in the examples. For example, the proteins can be expressed recombinantly and used to screen patient sera by immunoblot. A positive reaction between the protein and patient serum indicates that the patient has previously mounted an immune response to the protein in question ie. the protein is an immunogen. This method can also be used to identify immunodominant proteins.

The recombinant protein can also be conveniently used to prepare antibodies eg. in a mouse. These can be used for direct confirmation that a protein is located on the cell-surface. Labelled antibody (eg. fluorescent labelling for FACS) can be incubated with intact bacteria and the presence of label on the bacterial surface confirms the location of the protein.

In particular, the following methods (A) to (S) were used to express, purify and biochemically characterise the proteins of the invention:

A) Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris-HCl, 50 mM EDTA, pH8). After 10 minutes incubation on ice, the bacteria were lysed by adding 10 ml lysis solution (50 mM NaCl, 1% Na-Sarkosyl, 50 µg/ml Proteinase K), and the suspension was incubated at 37° C. for 2 hours. Two phenol extractions (equilibrated to pH 8) and one $ChCl_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4 ml buffer (10 mM Tris-HCl, 1 mM EDTA, pH 8). The DNA concentration was measured by reading the OD at 260 nm.

B) Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus as necessary. Any predicted signal peptides were omitted, by deducing the 5'-end amplification primer sequence immediately downstream from the predicted leader sequence.

For most ORFs, the 5' primers included two restriction enzyme recognition sites (BamHI-NdeI, BamHI-NheI, or EcoRI-NheI, depending on the gene's own restriction pattern); the 3' primers included a XhoI restriction site. This procedure was established in order to direct the cloning of each amplification product (corresponding to each ORF) into two different expression systems: pGEX-KG (using either BamHI-XhoI or EcoRI-XhoI), and pET21b+ (using either NdeI-XhoI or NheI-XhoI).

```
5'-end primer tail:          SEQ ID NO: 1099
CGCGGATCCCATATG              (BamHI-NdeI)

SEQ ID NO: 1100
CGCGGATCCGCTAGC              (BamnHI-NheI)

SEQ ID NO: 1101
CCGGAATTCTAGCTAGC            (EcoRI-NheI)

3'-end primer tail:          (SEQ ID NO: 1102)
CCCGCTCGAG                   (XhoI)
```

For ORFs 5, 15, 17, 19, 20, 22, 27, 28, 65 & 89, two different amplifications were performed to clone each ORF in the two expression systems. Two different 5' primers were used for each ORF; the same 3' XhoI primer was used as before:

```
5'-end primer tail:          SEQ ID NO: 1103
GGAATTCCATATGGCCATGG         (NdeI)

5'-end primer tail:
CGGGATCC                     (BamHI)
```

ORF 76 was cloned in the pTRC expression vector and expressed as an amino-terminus His-tag fusion. In this particular case, the predicted signal peptide was included in the final product. NheI-BamHI restriction sites were incorporated using primers:

```
5'-end primer tail:            SEQ ID NO: 1104
GATCAGCTAGCCATATG              (NheI)

3'-end primer tail:
CGGGATCC                       (BamHI)
```

As well as containing the restriction enzyme recognition sequences, the primers included nucleotides which hybridized to the sequence to be amplified. The number of hybridizing nucleotides depended on the melting temperature of the whole primer, and was determined for each primer using the formulae:

$$T_m = 4(G+C) + 2(A+T) \text{ (tail excluded)}$$

$$T_m = 64.9 + 0.41(\% GC) - 600/N \text{ (whole primer)}$$

The average melting temperature of the selected oligos were 65-70° C. for the whole oligo and 50-55° C. for the hybridising region alone.

Table I (page 487) shows the forward and reverse primers used for each amplification. In certain cases, it will be noted that the sequence of the primer does not exactly match the sequence in the ORF. When initial amplifications were performed, the complete 5' and/or 3' sequence was not known for some meningococcal ORFs, although the corresponding sequences had been identified in gonococcus. For amplification, the gonococcal sequences could thus be used as the basis for primer design, altered to take account of codon preference. In particular, the following codons were changed: ATA→ATT; TCG→TCT; CAG→CAA; AAG→AAA; GAG→GAA; CGA→CGC; CGG→CGC; GGG→GGC. Italicised nucleotides in Table I indicate such a change. It will be appreciated that, once the complete sequence has been identified, this approach is generally no longer necessary.

Oligos were synthesized by a Perkin Elmer 394 DNA/RNA Synthesizer, eluted from the columns in 2 ml NH$_4$OH, and deprotected by 5 hours incubation at 56° C. The oligos were precipitated by addition of 0.3M Na-Acetate and 2 volumes ethanol. The samples were then centrifuged and the pellets resuspended in either 100 µl or 1 ml of water. OD$_{260}$ was determined using a Perkin Elmer Lambda Bio spectophotometer and the concentration was determined and adjusted to 2-10 pmol/µl.

C) Amplification

The standard PCR protocol was as follows: 50-200ng of genomic DNA were used as a template in the presence of 20-40 µM of each oligo, 400-800 µM dNTPs solution, 1×PCR buffer (including 1.5 mM MgCl$_2$), 2.5 units TaqI DNA polymerase (using Perkin-Elmer AmpliTaQ, GIBCO Platinum, Pwo DNA polymerase, or Tahara Shuzo Taq polymerase).

In some cases, PCR was optimsed by the addition of 10 µl DMSO or 50 µl 2M betaine.

After a hot start (adding the polymerase during a preliminary 3 minute incubation of the whole mix at 95° C.), each sample underwent a double-step amplification: the first 5 cycles were performed using as the hybridization temperature the one of the oligos excluding the restriction enzymes tail, followed by 30 cycles performed according to the hybridization temperature of the whole length oligos. The cycles were followed by a final 10 minute extension step at 72° C.

The standard cycles were as follows:

|  | Denaturation | Hybridisation | Elongation |
|---|---|---|---|
| First 5 cycles | 30 seconds 95° C. | 30 seconds 50-55° C. | 30-60 seconds 72° C. |
| Last 30 cycles | 30 seconds 95° C. | 30 seconds 65-70° C. | 30-60 seconds 72° C. |

The elongation time varied according to the length of the ORF to be amplified.

The amplifications were performed using either a 9600 or a 2400 Perkin Elmer GeneAmp PCR System. To check the results, 1/10 of the amplification volume was loaded onto a 1-1.5% agarose gel and the size of each amplified fragment compared with a DNA molecular weight marker.

The amplified DNA was either loaded directly on a 1% agarose gel or first precipitated with ethanol and resuspended in a suitable volume to be loaded on a 1% agarose gel. The DNA fragment corresponding to the right size band was then eluted and purified from gel, using the Qiagen Gel Extraction Kit, following the instructions of the manufacturer. The final volume of the DNA fragment was 30 µl or 50 µl of either water or 10 mM Tris, pH 8.5.

D) Digestion of PCR Fragments

The purified DNA corresponding to the amplified fragment was split into 2 aliquots and double-digested with:
  NdeI/XhoI or NheI/XhoI for cloning into pET-21b+ and further expression of the protein as a C-terminus His-tag fusion
  BamHI/XhoI or EcoRI/XhoI for cloning into pGEX-KG and further expression of the protein as N-terminus GST fusion.
  For ORF 76, NheI/BamHI for cloning into pTRC-HisA vector and further expression of the protein as N-terminus His-tag fusion.
  EcoRI/PstI, EcoRI/SalI, SalI/PstI for cloning into pGex-His and further expression of the protein as N-terminus His-tag fusion Each purified DNA fragment was incubated (37° C. for 3 hours to overnight) with 20 units of each restriction enzyme (New England Biolabs) in a either 30 or 40 µl final volume in the presence of the appropriate buffer. The digestion product was then purified using the QIAquick PCR purification kit, following the manufacturer's instructions, and eluted in a final volume of 30 or 50 µl of either water or 10 mM Tris-HCl, pH 8.5. The final DNA concentration was determined by 1% agarose gel electrophoresis in the presence of titrated molecular weight marker.

E) Digestion of the Cloning Vectors (pET22B, pGEX-KG, pTRC-His A, and pGex-His)

10 µg plasmid was double-digested with 50 units of each restriction enzyme in 200 µl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 µl of 10 mM Tris-HCl, pH 8.5. The DNA concentration was evaluated by measuring OD$_{260}$ of the sample, and adjusted to 50 µg/µl. 1 µl of plasmid was used for each cloning procedure.

The vector pGEX-His is a modified pGEX-2T vector carrying a region encoding six histidine residues upstream to the thrombin cleavage site and containing the multiple cloning site of the vector pTRC99 (Pharmacia).

F) Cloning

The fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl E. coli DH5 competent cells were incubated with the ligase reaction solution for 40 minutes on ice, then at 37° C. for 3 minutes, then, after adding 800 μl LB broth, again at 37° C. for 20 minutes. The cells were then centrifuged at maximum speed in an Eppendorf microfuge and resuspended in approximately 200 μl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 μg/ml ampicillin. The cells were then pelletted and the DNA extracted using the Qiagen QIAprep Spin Miniprep Kit, following the manufacturer's instructions, to a final volume of 30 μl. 5 μl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For the cloning of ORFs 110, 111, 113, 115, 119, 122, 125 & 130, the double-digested PCR product was ligated into double-digested vector using EcoRI-PstI cloning sites or, for ORFs 115 & 127, EcoRI-SalI or, for ORF 122, SalI-PstI. After cloning, the recombinant plasmids were introduced in the E. coli host W3110. Individual clones were grown overnight at 37° C. in L-broth with 50 μl/ml ampicillin.

G) Expression

Each ORF cloned into the expression vector was transformed into the strain suitable for expression of the recombinant protein product. 1 μl of each construct was used to transform 30 μl of E. coli BL21 (pGEX vector), E. coli TOP 10 (PTRC vector) or E. coli BL21-DE3 (PET vector), as described above. In the case of the pGEX-His vector, the same E. coli strain (W3110) was used for initial cloning and expression. Single recombinant colonies were inoculated into 2 ml LB+Amp (100 μg/ml), incubated at 37° C. overnight, then diluted 1:30 in 20 ml of LB+Amp (100 μg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-1 OD for pGEX and pGEX-His vectors). For the pET, pTRC and pGEX-His vectors, the protein expression was induced by addition of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

H) GST-Fusion Proteins Large-Scale Purification.

A single colony was grown overnight at 37° C. on LB+Amp agar plate. The bacteria were inoculated into 20 ml of LB+Amp liquid cloture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 800 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed twice and centrifuged again. The supernatant was collected and mixed with 150 μl Glutatione-Sepharose 4B resin (Pharmacia) (previously washed with PBS) and incubated at room temperature for 30 minutes. The sample was centrifuged at 700 g for 5 minutes at 4° C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 μl cold Glutathione elution buffer (10 mM reduced glutathione, 50 mM Tris-HCl) and fractions collected until the $OD_{280}$ was 0.1. 21 μl of each fraction were loaded on a 12% SDS gel using either Biorad SDS-PAGE Molecular weight standard broad range (M1) (200, 116.25, 97.4, 66.2, 45,31, 21.5, 14.4, 6.5 kDa) or Amersham Rainbow Marker (M2) (220, 66, 46, 30, 21.5, 14.3 kDa) as standards. As the MW of GST is 26 kDa, this value must be added to the MW of each GST-fusion protein.

I) His-Fusion Solubility Analysis (ORFs 111-129)

To analyse the solubility of the His-fusion expression products, pellets of 3 ml cultures were resuspended in buffer M1 [500 μl PBS pH 7.2]. 25 μl lysozyme (10 mg/ml) was added and the bacteria were incubated for 15 min at 4° C. The pellets were sonicated for 30 sec at 40 W using a Branson sonifier B-15, frozen and thawed twice and then separated again into pellet and supernatant by a centrifugation step. The supernatant was collected and the pellet was resuspended in buffer M2 [8M urea, 0.5M NaCl, 20 mM imidazole and 0.1 M $NaH_2PO_4$] and incubated for 3 to 4 hours at 4° C. After centrifugation, the supernatant was collected and the pellet was resuspended in buffer M3 [6M guanidinium-HCl, 0.5M NaCl, 20 mM imidazole and 0.1 M $NaH_2PO_4$] overnight at 4° C. The supernatants from all steps were analysed by SDS-PAGE.

The proteins expressed from ORFs 113, 119 and 120 were found to be soluble in PBS, whereas ORFs 111, 122, 126 and 129 need urea and ORFs 125 and 127 need guanidium-HCl for their solubilization.

J) His-Fusion Large-Scale Purification.

A single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 800 rpm at 4° C., the supernatant was discarded and the bacterial pellet was resuspended in 7.5 ml of either (i) cold buffer A (300 mM NaCl, 50 mM phosphate buffer, 10 mM imidazole, pH 8) for soluble proteins or (ii) buffer B (urea 8M, 10 mM Tris-HCl, 100 mM phosphate buffer, pH 8.8) for insoluble proteins. The cells were disrupted by sonication on ice for 30 sec at 40 W using a Branson sonifier B-15, frozen and thawed two times and centrifuged again.

For insoluble proteins, the supernatant was stored at −20° C., while the pellets were resuspended in 2 ml buffer C (6M guanidine hydrochloride, 100 mM phosphate buffer, 10 mM Tris-HCl, pH 7.5) and treated in a homogenizer for 10 cycles. The product was centrifuged at 13000 rpm for 40 minutes.

Supernatants were collected and mixed with 150 μl $Ni^{2+}$-resin (Pharmacia) (previously washed with either buffer A or buffer B, as appropriate) and incubated at room temperature with gentle agitation for 30 minutes. The sample was centrifuged at 700 g for 5 minutes at 4° C. The resin was washed twice with 10 ml buffer A or B for 10 minutes, resuspended in 1 ml buffer A or B and loaded on a disposable column. The resin was washed at either (i) 4° C. with 2 ml cold buffer A or (ii) room temperature with 2 ml buffer B, until the flow-through reached $OD_{280}$ of 0.02-0.06.

The resin was washed with either (i) 2 ml cold 20 mM imidazole buffer (300 mM NaCl, 50 mM phosphate buffer, 20 mM imidazole, pH 8) or (ii) buffer D (urea 8M, 10 mM Tris-HCl, 100 mM phosphate buffer, pH 6.3) until the flow-through reached the $O.D_{280}$ of 0.02-0.06. The His-fusion protein was eluted by addition of 700 μl of either (i) cold elution buffer A (300 mM NaCl, 50 mM phosphate buffer, 250 mM imidazole, pH 8) or (ii) elution buffer B (urea 8M, 10 mM Tris-HCl, 100 mM phosphate buffer, pH 4.5) and fractions collected until the $O.D_{280}$ was 0.1. 21 μl of each fraction were loaded on a 12% SDS gel.

K) His-Fusion Proteins Renaturation

10% glycerol was added to the denatured proteins. The proteins were then diluted to 20 μg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C. Protein concentration was evaluated using the formula:

$$\text{Protein (mg/ml)} = (1.55 \times OD_{280}) - (0.76 \times OD_{260})$$

L) His-Fusion Large-Scale Purification (ORFs 111-129)

500 ml of bacterial cultures were induced and the fusion proteins were obtained soluble in buffer M1, M2 or M3 using the procedure described above. The crude extract of the bacteria was loaded onto a Ni-NTA superflow column (Quiagen) equilibrated with buffer M1, M2 or M3 depending on the solubilization buffer of the fusion proteins. Unbound material was eluted by washing the column with the same buffer. The specific protein was eluted with the corresponding buffer containing 500 mM imidazole and dialysed against the corresponding buffer without imidazole. After each run the columns were sanitized by washing with at least two column volumes of 0.5 M sodium hydroxide and reequilibrated before the next use.

M) Mice Immunisations

20 μg of each purified protein were used to immunise mice intraperitoneally. In the case of ORFs 2, 4, 15, 22, 27, 28, 37, 76, 89 and 97, Balb-C mice were immunised with $Al(OH)_3$ as adjuvant on days 1, 21 and 42, and immune response was monitored in samples taken on day 56. For ORFs 44, 106 and 132, CD1 mice were immunised using the same protocol. For ORFs 25 and 40, CD1 mice were immunised using Freund's adjuvant, rather than $AL(OH)_3$, and the same immunisation protocol was used, except that the immune response was measured on day 42, rather than 56. Similarly, for ORFs 23, 32,38 and 79, CD1 mice were immunised with Freund's adjuvant, but the immune response was measured on day 49.

N) ELISA Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stirring. 100 μl bacterial cells were added to each well of a 96 well Greiner plate and incubated overnight at 4° C. The wells were then washed three times with PBT washing buffer (0.1% Tween-20 in PBS). 200 μl of saturation buffer (2.7% Polyvinylpyrrolidone 10 in water) was added to each well and the plates incubated for 2 hours at 37° C. Wells were washed three times with PBT. 200 μl of diluted sera (Dilution buffer: 1% BSA, 0.1% Tween-20, 0.1% $NaN_3$ in PBS) were added to each well and the plates incubated for 90 minutes at 37° C. Wells were washed three times with PBT. 100 μl of HRP-conjugated rabbit anti-mouse (Dako) serum diluted 1:2000 in dilution buffer were added to each well and the plates were incubated for 90 minutes at 37° C. Wells were washed three times with PBT buffer. 100 μl of substrate buffer for HRP (25 ml of citrate buffer pH5, 10 mg of O-phenildiamine and 10 μl of $H_2O$) were added to each well and the plates were left at room temperature for 20 minutes. 100 μl $H_2SO_4$ was added to each well and $OD_{490}$ was followed. The ELISA was considered positive when $OD_{490}$ was 2.5 times the respective pre-immune sera.

O) FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% $NaN_3$) and centrifuged for 5 minutes at 400 rpm. Cells were resuspended in blocking buffer to reach $OD_{620}$ of 0.07. 100 μl bacterial cells were added to each well of a Costar 96 well plate. 100 μl of diluted (1:200) sera (in blocking buffer) were added to each well and plates incubated for 2 hours at 4° C. Cells were centrifuged for 5 minutes at 400 rpm, the supernatant aspirated and cells washed by addition of 200 μl/well of blocking buffer in each well. 100 μl of R-Phicoerytrin conjugated $F(ab)_2$ goat anti-mouse, diluted 1:100, was added to each well and plates incubated for 1 hour at 4° C. Cells were spun down by centrifugation at 400 rpm for 5 minutes and washed by addition of 200 μl/well of blocking buffer. The supernatant was aspirated and cells resuspended in 200 μl/well of PBS, 0.25% formaldehyde. Samples were transferred to FACScan tubes and read. The condition for FACScan setting were: FL1 on, FL2 and FL3 off; FSC-H threshold:92; FSC PMT Voltage: E 02; SSC PMT: 474; Amp. Gains 7.1; FL-2 PMT: 539; compensation values: 0.

P) OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10 minutes on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Q) Whole Extracts Preparation

Bacteria were grown overnight on a GC plate, harvested with a loop and resuspended in 1 ml of 20 mM Tris-HCl. Heat inactivation was performed at 56° C. for 30 minutes.

R) Western Blotting

Purified proteins (500 ng/lane), outer membrane vesicles (5 µg) and total cell extracts (25 µg) derived from MenB strain 2996 were loaded on 15% SDS-PAGE and transferred to a nitrocellulose membrane. The transfer was performed for 2 hours at 150 mA at 4° C., in transferring buffer (0.3% Tris base, 1.44% glycine, 20% methanol). The membrane was saturated by overnight incubation at 4° C. in saturation buffer (10% skimmed milk, 0.1% Triton X100 in PBS). The membrane was washed twice with washing buffer (3% skimmed milk, 0.1% Triton X100 in PBS) and incubated for 2 hours at 37° C. with mice sera diluted 1:200 in washing buffer. The membrane was washed twice and incubated for 90 minutes with a 1:2000 dilution of horseradish peroxidase labelled anti-mouse Ig. The membrane was washed twice with 0.1% Triton X100 in PBS and developed with the Opti-4CN Substrate Kit (Bio-Rad). The reaction was stopped by adding water.

S) Bactericidal Assay

MC58 strain was grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 µl of Gey's buffer/1% BSA was added to each well of a 96-well tissue culture plate. 25 µl of diluted mice sera (1:100 in Gey's buffer/0.2% BSA) were added to each well and the plate incubated at 4° C. 25 µl of the previously described bacterial suspension were added to each well. 25 µl of either heat-inactivated (56° C. waterbath for 30 minutes) or normal baby rabbit complement were added to each well. Immediately after the addition of the baby rabbit complement, 22 µl of each sample/well were plated on Mueller-Hinton agar plates (time 0). The 96-well plate was incubated for 1 hour at 37° C. with rotation and then 22 µl of each sample/well were plated on Mueller-Hinton agar plates (time 1). After overnight incubation the colonies corresponding to time 0 and time 1 hour were counted.

Table II (page 493) gives a summary of the cloning, expression and purification results.

Example 1

The following partial DNA sequence was identified in *N. meningitidis* <SEQ ID 1>:

```
  1 ATGAAACAGA CAGTCAA.AT GCTTGCCGCC GCCCTGATTG CCTTGGGCTT

51 GAACCGACCG GTGTGGNCGG ATGACGTATC GGATTTTCGG GAAAACTTGC

101 A.GCGGCAGC ACAGGGAAAT GCAGCAGCCC AATACAATTT GGGCGCAATG

151 TAT.TACAAA GGACGCGCGT GCGCCGGGAT GATGCTGAAG CGGTCAGATG

201 GTATCGGCAG CCGGCGGAAC AGGGGTTAGC CCAAGCCCAA TACAATTTGG

251 GCTGGATGTA TGCCAACGGG CGCGC.GTGC GCCAAGATGA TACCGAAGCG

301 GTCAGATGGT ATCGGCAGGC GGCAGCGCAG GGGGTTGTCC AAGCCCAATA

351 CAATTTGGGC GTGATATATG CCGAAGGACG TGGAGTGCGC CAAGACGATG

401 TCGAAGCGGT CAGATGGTTT CGGCAGGCGG CAGCGCAGGG GGTAGCCCAA

451 GCCCAAAACA ATTTGGGCGT GATGTATGCC GAAAGANCGC GCGTGCGCCA

501 AGACCG...
```

This corresponds to the amino acid sequence <SEQ ID 2; ORF37>:

```
  1 MKQTVXMLAA ALIALGLNRP VWXDDVSDFR ENLXAAAQGN AAAQYNLGAM

51 YXQRTRVRRD DAEAVRWYRQ PAEQGLAQAQ YNLGWMYANG RXVRQDDTEA

101 VRWYRQAAAQ GVVQAQYNLG VIYAEGRGVR QDDVEAVRWF RQAAAQGVAQ

151 AQNNLGVMYA ERXRVRQD...
```

Further work revealed the complete nucleotide sequence <SEQ ID 3>:

```
  1 ATGAAACAGA CAGTCAAATG GCTTGCCGCC GCCCTGATTG CCTTGGGCTT
 51 GAACCGAGCG GTGTGGGCGG ATGACGTATC GGATTTTCGG GAAAACTTGC
101 AGGCGGCAGC ACAGGGAAAT GCAGCAGCCC AATACAATTT GGGCGCAATG
151 TATTACAAAG GACGCGGCGT GCGCCGGGAT GATGCTGAAG CGGTCAGATG
201 GTATCGGCAG GCGGCGGAAC AGGGGTTAGC CCAAGCCCAA TACAATTTGG
251 GCTGGATGTA TGCCAACGGG CGCGGCGTGC GCCAAGATGA TACCGAAGCG
301 GTCAGATGGT ATCGGCAGGC GGCAGCGCAG GGGGTTGTCC AAGCCCAATA
351 CAATTTGGGC GTGATATATG CCGAAGGACG TGGAGTGCGC CAAGACGATG
401 TCGAAGCGGT CAGATGGTTT CGGCAGGCGG CAGCGCAGGG GGTAGCCCAA
451 GCCCAAAACA ATTTGGGCGT GATGTATGCC GAAAGACGCG GCGTGCGCCA
501 AGACCGCGCC CTTGCACAAG AATGGTTTGG CAAGGCTTGT CAAAACGGAG
551 ACCAAGACGG CTGCGACAAT GACCAACGCC TGAAGGCGGG TTATTGA
```

This corresponds to the amino acid sequence <SEQ ID 4; ORF37-1>:

```
  1 MKQTVKWLAA ALIALGLNRA VWADDVSDFR ENLQAAAQGN AAAQYNLGAM
 51 YYKGRGVRRD DAEAVRWYRQ AAEQGLAQAQ YNLGWMYANG RGVRQDDTEA
101 VRWYRQAAAQ GVVQAQYNLG VIYAEGRGVR QDDVEAVRWF RQAAAQGVAQ
151 AQNNLGVMYA ERRGVRQDRA LAQEWFGKAC QNGDQDGCDN DQRLKAGY*
```

Further work identified the corresponding gene in strain A of *N. meningitidis* <SEQ ID 5>:

```
  1 ATGAAACAGA CAGTCAAATG GCTTGCCGCC GCCCTGATTG CCTTGGGCTT
 51 GAACCAAGCG GTGTGGGCGG ATGACGTATC GGATTTTCGG GAAAACTTGC
101 AGGCGGCAGC ACAGGGAAAT GCAGCAGCCC AAAACAATTT GGGCGTGATG
151 TATGCCGAAA GACGCGGCGT GCGCCAAGAC CGCGCCCTTG CACAAGAATG
201 GCTTGGCAAG GCTTGTCAAA ACGGATACCA AGACAGCTGC GACAATGACC
251 AACGCCTGAA AGCGGGTTAT TGA
```

This encodes a protein having amino acid sequence <SEQ ID 6; ORF37a>:

```
  1 MKQTVKWLAA ALIALGLNQA VWADDVSDFR ENLQAAAQGN AAAQNNLGVM
 51 YAERRGVRQD RALAQEWLGK ACQNGYQDSC DNDQRLKAGY *
```

The originally-identified partial strain B sequence (ORF37) shows 68.0% identity over a 75aa overlap with ORF37a:

```
                  10         20         30         40         50         60
orf37.pep  MKQTVXMLAAALIALGLNRPVWXDDVSDFRENLXAAAQGNAAAQYNLGAMYXQRTRVRRD
           ||||| |||||||||||| :| || ||||||||||| |||||||||||| |||:|| :|  ||:|
orf37a     MKQTVKWLAAALIALGLNQAVWADDVSDFRENLQAAAQGNAAAQNNLGVMYAERRGVRQD
                  10         20         30         40         50         60
                  70         80         90        100        110        120
orf37.pep  DAEAVRWYRQPAEQGLAQAQYNLGWMYANGRXVRQDDTEAVRWYRQAAAQGVVQAQYNLG
           || |  :|   ::|
orf37a     RALAQEWLGKACQNGYQDSCDNDQRLKAGYX
                  70         80         90
```

Further work identified the corresponding gene in *N. gonorrhoeae* <SEQ ID 7>:

```
  1 ATGAAACAGA CAGTCAAATG GCTTGCCGCC GCCCTGATTG
    CCTTGGGCTT

51 GAACCAAGCG GTGTGGGCGG GTGACGTATC GGATTTTCGG
    GAAAACTTGC

101 AGgcggcaGA ACaggGAAAT GCAGCAGCCC AATTCAATTT
    GGGCGTGATG

151 TATGAAAATG GACAAGGAGT TCGTCAAGAT TATGTACAGG
    CAGTGCAGTG

201 GTATCGCAAG GCTTCAGAAC AAGGGGATGC CCAAGCCCAA
    TACAATTTGG

251 GCTTGATGTA TTACGATGGA CGCGGCGTGC GCCAAGACCT
    TGCGCTCGCT

301 CAACAATGGC TTGGCAAGGC TTGTCAAAAC GGAGACCAAA
    ACAGCTGCGA

351 CAATGACCAA CGCCTGAAGG CGGGTTATTA A
```

This encodes a protein having amino acid sequence <SEQ ID 8; ORF37ng>:

```
  1 MKQTVKWLAA ALIALGLNQA VWAGDVSDFR ENLQAAEQGN
    AAAQFNLGVM

51 YENGQGVRQD YVQAVQWYRK ASEQGDAQAQ YNLGLMYYDG
    RGVRQDLALA

101 QQWLGKACQN CDQNSCDNDQ RLKAGY*
```

The originally-identified partial strain B sequence (ORF37) shows 64.9% identity over a 111aa overlap with ORF37ng:

```
orf37.pep  MKQTVXMLAAALIALGLNRPVWXDDVSDFRENLXAAAQGNAAAQYNLGAMYXQRTRVRRD  60
           ||||| |||||||||||| :| || ||||||||||| || ||||||||:|| :   ||:|
orf37ng    MKQTVKWLAAALIALGLNQAVWAGDVSDFRENLQAAEQGNAAAQFNLGVMYENGQGVRQD  60 orf37.pep  DAEAVRWYRQPAEQGLAQAQYNLGWMYANGRXVRQDDTEAVRWYRQAAAQGVVQAQYNLG  120
           : :||:|||: :||| |||||||| || :|| |||| :  |:| :|  :|
orf37ng    YVQAVQWYRKASEQGDAQAQYNLGLMYYDGRGVRQDLALAQQWLGKACQNGDQNSCDNDQ  120 orf37.pep  VIYAEGRGVRQDDVEAVRWFRQAAAQGVAQAQNNLGVMYAERXRVRQD  168
orf37ng    RLKAGY                                           126
```

The complete strain B sequence (ORF37-1) and ORF37ng show 51.5% identity in 198 aa overlap:

```
              10         20         30         40         50         60
orf37-1.pep  MKQTVKWLAAALIALGLNRAVWADDVSDFRENLQAAAQGNAAAQYNLGAMYYKGRGVRRD
             |||||||||||||||||||:||| ||||||||||||| |||||||||||:|||:| :|||:|
orf37ng      MKQTVKWLAAALIALGLNQAVWAGDVSDFRENLQAAEQGNAAAQFNLGVMYENGQGVRQD
              10         20         30         40         50         60
              70         80         90        100        110        120
orf37-1.pep  DAEAVRWYRQAAEQGLAQAQYNLGWMYANGRGVRQDDTEAVRWYRQAAAQGVVQAQYNLG
             ::|:|||:|||  ||||||||| |||||||| :
orf37ng      YVQAVQWYRKASEQGDAQAQYNLGLMYYDGRGVRQD-----------------------
                      70         80         90
                     130        140        150        160        170        180
orf37-1.pep  VIYAEGRGVRQDDVEAVRWFRQAAAQGVAQAQNNLGVMYAERRGVRQDRALAQEWFGKAC
                                                                 |||||:|:||||
orf37ng      ---------------------------------------------LALAQQWLGKAC
                                                                           100
              190        199
orf37-1.pep  QNGDQDGCNDDQRLKAGYX
             ||||::|||||||||||||
orf37ng      QNGDQNSCDNDQRLKAGYX
              110        120
```

Computer analysis of these amino acid sequences indicates a putative leader sequence, and it was predicted that the proteins from *N. meningitidis* and *N. gonorrhoeae*, and their epitopes, could be useful antigens for vaccines or diagnostics, or for raising antibodies.

ORF37-1 (11 kDa) was cloned in pET and pGex vectors and expressed in *E. coli*, as described above. The products of protein expression and purification were analyzed by SDS-PAGE. FIG. 1A shows the results of affinity purification of the GST-fusion protein, and FIG. 1B shows the results of expression of the His-fusion in *E. coli*. Purified GST-fusion protein was used to immunise mice, whose sera were used for ELISA (positive result), FACS analysis (FIG. 1C), and a bactericidal assay (FIG. 1D). These experiments confirm that ORF37-1 is a surface-exposed protein, and that it is a useful immunogen.

FIG. 1E shows plots of hydrophilicity, antigenic index, and AMPHI regions for ORF37-1.

Example 2

The following partial DNA sequence was identified in *N. meningitidis* <SEQ ID 9>:

```
TTCGGCGA CATCGGCGGT TTGAAGGTCA ATGCCCCCGT CAAATCCGCA

GGCGTATTGG TCGGGCGCGT CGGCGCTATC GGACTTGACC CGAAATCCTA

TCAGGCGAGG GTGCGCCTCG ATTTGGACGG CAAGTATCAG TTCAGCAGCG

ACGTTTCCGC GCAAATCCTG ACTTCsGGAC TTTTGGGCGA GCAGTACATC

GGGCTGCAGC AGGGCGGCGA CACGGAAAAC CTTGCTGCCG GCGACACCAT

CTCCGTAACC AGTTCTGCAA TGGTTCTGGA AAACCTTATC GGCAAATTCA

TGACGAGTTT TGCCGAGAAA AATGCCGACG GCGGCAATGC GGAAAAAGCC

GCCGAATAA
```

This corresponds to the amino acid sequence <SEQ ID 10>:

```
  1 FGDIGGLKVN APVKSAGVLV GRVGAIGLDP KSYQARVRLD LDGKYQFSSD

51 VSAQILTSGL LGEQYIGLQQ GGDTENLAAG DTISVTSSAM VLENLIGKFM

101 TSFAEKNADG GNAEKAAE*
```

Computer analysis of this amino acid sequence gave the following results:

Homology with a Hypothetical *H. influenzae* Protein (ybrd.haein; Accession Number p45029)

SEQ ID 9 and ybrd.haein show 48.4% aa identity in 122 aa overlap:

```
                20         30         40         50         60         70
yrbd.h  LGIGALVFLGLRVANVQGFAETKSYTVTATFDNIGGLKVRAPLKIGGVVIGRVSAITLDE
                              |::||||||:||:|  :||::|||:||:||
N.m                           FGDIGGLKVNAPVKSAGVLVGRVGAIGLDP
                                       10         20         30

80         90        100        110        120        130
yrbd.h  KSYLPKVSIAINQEYNEIPENSSLSIKTSGLLGEQYIALTMGFDDGDTAMLKNGSQIQDT
        |||  ::|:::::  :|  :::::  |    |||||||||||:|    |||: |  :|:   |    |
N.m     KSYQARVRLDLDGKY-QFSSDVSAQILTSGLLGEQYIGLQQG---GDTENLAAGDTISVT
                 40         50         60         70         80

140        150        160
yrbd.h  TSAMVLEDLIGQFL--YGSKKSDGNEKSESTEQ
        :||||||:|||:|:    :::|::||::  ::::|:
N.m     SSAMVLENLIGKFMTSFAEKNADGGNAEKAAEX
                 90        100        110        120
```

Homology with a Predicted ORF from *N. gonorrhoeae*
SEQ ID 9 shows 99.2% identity over a 118aa overlap with a predicted ORF from *N. gonorrhoeae*:

```
            20        30        40        50        60        70
yrbd    GAAAVAFLAFRVAGGAAFGGSDKTYAVYADFGDIGGLKVNAPVKSAGVLVGRVGAIGLDP
                                    ||||||||||||||||||||||||||||
N.m                                 FGDIGGLKVNAPVKSAGVLVGRVGAIGLDP
                                      10        20        30
            80        90       100       110       120       130
yrbd    KSYQARVRLDLDGKYQFSSDVSAQILTSGLLGEQYIGLQQGGDTENLAAGDTISVTSSAM
        ||||||||||||||||||||||||||||||||||||||||||||||||||||||||||||
N.m     KSYQARVRLDLDGKYQFSSDVSAQILTSGLLGEQYIGLQQGGDTENLAAGDTISVTSSAM
              40        50        60        70        80        90
           140       150       160
yrbd    VLENLIGKFMTSFAEKNAEGGNAEKAAEX
        |||||||||||||||:||||||||||||
N.m     VLENLIGKFMTSFAEKNADGGNAEKAAEX
              100       110       120
```

The complete yrbd *H. influenzae* sequence has a leader sequence and it is expected that the full-length homologous *N. meningitidis* protein will also have one. This suggests that it is either a membrane protein, a secreted protein, or a surface protein and that the protein, or one of its epitopes, could be a useful antigen for vaccines or diagnostics.

Example 3

The following partial DNA sequence was identified in *N. meningitidis* <SEQ ID 11>:

```
  1  ..ATTTTGATAT ACCTCATCCG CAAGAATCTA GGTTCGCCCG TCTTCTTCTT
 51    TCAGGAACGC CCCGGAAAGG ACGGAAAACC TTTTAAAATG GTCAAATTCC
101    GTTCCATGCG CGACGGCTTG TATTCAGACG GCATTCCGCT GCCCGACGGA
151    GAACGCCTGA CACCGTTCGG CAAAAAACTG CGTGCCGcCA GTwTGGACGA
201    ACTGCCTGAA TTATGGAATA TCTTAAAAGG CGAGATGAGC CTGGTCGGCC
251    CCCGCCCGCT GCTGATGCAA TATCTGCCGC TGTACGACAA CTTCCAAAAC
301    CGCCGCCACG AAATGAAACC CGGCATTACC GGCTGGGCGC AGGTCAACGG
351    GCGCAACGCg CTTTCGTGGG ACGAAAAATT CGCCTGCGAT GTTTGGTATA
401    TCGACCACTT CAGCCTGTGC CTCGACATCA AAATCCTACT GCTGACGGTT
451    AAAAAAGTAT TAATCAAGGA AGGGATTTCC GCACAGGGCG AACA.aCCAT
501    GCCCCCTTTC ACAGGAAAAC GCAAACTCGC CGTCGTCGGT GCGGGCGGAC
551    ACGGAAAAGT CGTTGCCGAC CTTGCCGCCG CACTCGGCCG GTACAGGGAA
601    ATCGTTTTTC TGGACGACCG CGCACAAGGC AGCGTCAACG GCTTTTCCGT
651    CATCGGCACG ACGCTGCTGC TTGAAAACAG TTTATCGCCC GAACAATACG
701    ACGTCGCCGT CGCCGTCGGC AACAACCGCA TCCGCCGCCA AATCGCCGAA
751    AAAGCCGCCG CGCTCGGCTT CGCCCTGCCC GTACTGGTTC ATCCGGACGC
801    GACCGTCTCG CCTTCTGCAA CAGTCGGACA AGGCAGCGTC GTTATGGCGA
851    AAGCGGTCG..
```

This corresponds to the amino acid sequence <SEQ ID 12; ORF3>:

```
  1 ..ILIYLIRKNL GSPVFFFQER PGKDGKPFKM VKFRSMRDGL YSDGIPLPDG
 51   ERLTPFGKKL RAASXDELPE LWNILKGEMS LVGPRPLIMQ YLPLYDNFQN
101   RRHEMKPGIT GWAQVNGRNA LSWDEKFACD VWYIDHFSLC LDIKILLLTV
151   KKVLIKEGIS AQGEXTMPPF TGKRKLAVVG AGGHGKVVAD LAAALGRYRE
201   IVFLDDRAQG SVNGFSVIGT TLLLENSLSP EQYDVAVAVG NNRIRRQIAE
251   KAAALGFALP VLVHPDATVS PSATVGQGSV VMAKAV..
```

Further sequence analysis revealed the complete nucleotide sequence <SEQ ID 13>:

```
   1 ATGAGTAAAT TCTTCAAACG CCTGTTTGAC ATTGTTGCCT CCGCCTCGGG
  51 ACTGATTTTC CTCTCGCCAG TATTTTTGAT TTTGATATAC CTCATCCGCA
 101 AGAATCTAGG TTCGCCCGTC TTCTTCTTTC AGGAACGCCC CGGAAAGGAC
 151 GGAAAACCTT TTAAAATGGT CAAATTCCGT TCCATGCGCG ACGCGCTTGA
 201 TTCAGACGGC ATTCCGCTGC CGACGGAGA ACGCCTGACA CCGTTCGGCA
 251 AAAAACTGCG TGCCGCCAGT TTGGACGAAC TGCCTGAATT ATGGAATATC
 301 TTAAAAGGCG AGATGAGCCT GGTCGGCCCC CGCCCGCTGC TGATGCAATA
 351 TCTGCCGCTG TACGACAACT TCCAAAACCG CCGCCACGAA ATGAAACCCG
 401 GCATTACCGG CTGGGCGCAG GTCAACGGGC GCAACGCGCT TTCGTGGGAC
 451 GAAAAATTCG CCTGCGATGT TTGGTATATC GACCACTTCA GCCTGTGCCT
 501 CGACATCAAA ATCCTACTGC TGACGGTTAA AAAAGTATTA ATCAAGGAAG
 551 GGATTTCCGC ACAGGGCGAA GCCACCATGC CCCCTTTCAC AGGAAAACGC
 601 AAACTCGCCG TCGTCGGTGC GGGCGGACAC GGAAAAGTCG TTGCCGACCT
 651 TGCCGCCGCA CTCGGCCGGT ACAGGGAAAT CGTTTTTCTG GACGACCGCG
 701 CACAAGGCAG CGTCAACGGC TTTTCCGTCA TCGGCACGAC GCTGCTGCTT
 751 GAAAACAGTT TATCGCCCGA ACAATACGAC GTCGCCGTCG CCGTCGGCAA
 801 CAACCGCATC CGCCGCCAAA TCGCCGAAAA AGCCGCCGCG CTCGGCTTCG
 851 CCCTGCCCGT TCTGGTTCAT CCGGACGCGA CCGTCTCGCC TTCTGCAACA
 901 GTCGGACAAG GCAGCGTCGT TATGGCGAAA GCCGTCGTAC AGGCAGGCAG
 951 CGTATTGAAA GACGGCGTGA TTGTGAACAC TGCCGCCACC GTCGATCACG
1001 ACTGCCTGCT TAACGCTTTC GTCCACATCA GCCCAGGCGC GCACCTGTCG
1051 GGCAACACGC ATATCGGCGA AGAAAGCTGG ATAGGCACGG GCGCGTGCAG
1101 CCGCCAGCAG ATCCGTATCG GCAGCCGCGC AACCATTGGA GCGGGCGCAG
1151 TCGTCGTACG CGACGTTTCA GACGGCATGA CCGTCGCGGG CAATCCGGCA
1201 AAGCCGCTGC CGCGCAAAAA CCCCGAGACC TCGACAGCAT AA
```

This corresponds to the amino acid sequence <SEQ ID 14; ORF3-1>:

```
  1 MSKFFKRLFD IVASASGLIF LSPVFLILIY LIRKNLGSPV FFFQERPGKD
 51 GKPFKMVKFR SMRDALDSDG IPLPDGERLT PFGKKLRAAS LDELPELWNI
101 LKGEMSLVGP RPLLMQYLPL YDNFQNRRHE MKPGITGWAQ VNGRNALSWD
151 EKFACDVWYI DHFSLCLDIK ILLLTVKKVL IKEGISAQGE ATMPPFTGKR
201 KLAVVGAGGH GKVVADLAAA LGRYREIVFL DDRAQGSVNG FSVIGTTLLL
251 ENSLSPEQYD VAVAVGNNRI RRQIAEKAAA LGFALPVLVH PDATVSPSAT
301 VGQGSVVMAK AVVQAGSVLK DGVIVNTAAT VDHDCLLNAF VHISPGAHLS
351 GNTHIGEESW IGTGACSRQQ IRIGSRATIG AGAVVVRDVS DGMTVAGNPA
401 KPLPRKNPET STA*
```

Computer analysis of this amino acid sequence gave the following results:

Homology with a Predicted ORF from *N. meningitidis* (Strain A)

ORF3 shows 93.0% identity over a 286aa overlap with an ORF (ORF3a) from strain A of *N. meningitidis*:

```
                              10         20         30
orf3.pep                      ILIYLIRKNLGSPVFFFQERPGKDGKPFKMVKFR
                              |||||||||||||||||||||||||||||||||
orf3a    MSKFFKRLFDIVASASGLIFLSPVFLILIYLIRKNLGSPVFFFQERPGKDGKPFKMVKFR
              10        20        30        40        50        60
               40        50        60        70        80        90
orf3.pep    SMRDGLYSDGIPLPDGERLTPFGKKLRAASXDELPELWNILKGEMSLVGPRPLLMQYLPL
            ||:|| |||| ||||||||||||||||||| |||||||||:|||:||||||||||||||
orf3a       SMHDALDSDGILLPDGERLTPFGKKLRAASLDELPELWNVLKGDMSLVGPRPLLMQYLPL
              70        80        90       100       110       120
              100       110       120       130       140       150
orf3.pep    YDNFQNRRHEMKPGITGWAQVNGRNALSWDEKFACDVWYIDHFSLCLDIKILLLTVKKVL
            |||||||||||||||||||||||||||||||:||||:|||||||||||||||||||||||
orf3a       YDNFQNRRHEMKPGITGWAQVNGRNALSWDERFACDIWYIDHFSLCLDIKILLLTVKKVL
              130       140       150       160       170       180
              160       170       180       190       200       210
orf3.pep    IKEGISAQGEXTMPPFTGKRKLAVVGAGGHGKVVADLAAALGRYREIVFLDDRAQGSVNG
            ||||||||||| |||||||||||||||||||||:|||||| |||||||||||:||||||
orf3a       IKEGISAQGEATMPPFTGKRKLAVVGAGGHGKVVAELAAALGTYGEIVFLDDRVQGSVNG
              190       200       210       220       230       240
              220       230       240       250       260       270
orf3.pep    FSVIGTTLLLENSLSPEQYDVAVAVGNNRIRRQIAEKAAALGFALPVLVHPDATVSPSAT
            | ||||||||||||||||:|:|||||||||||||||||||||||||||:|||:|||||||
orf3a       FPVIGTTLLLENSLSPEQFDIAVAVGNNRIRRQIAEKAAALGFALPVLIHPDSTVSPSAT
              250       260       270       280       290       300
              280
orf3.pep    VGQGSVVMAKAV
            ||||:|||||||
orf3a       VGQGGVVMAKAVVQADSVLKDGVIVNTAATVDHDCLLDAFVHISPGAHLSGNTRIGEESW
              310       320       330       340       350       360
```

The complete length ORF3a nucleotide sequence <SEQ ID 15> is:

```
  1 ATGAGTAAAT TCTTCAAACG CCTGTTTGAC ATTGTTGCCT CCGCCTCGGG
 51 ACTGATTTTC CTCTCGCCAG TATTTTTGAT TTTGATATAC CTCATCCGCA
101 AGAATCTGGG TTCGCCCGTC TTCTTCTTTC AGGAACGCCC CGGAAAGGAC
151 GGAAAACCTT TTAAAATGGT CAAATTCCGT TCCATGCACG ACGCGCTTGA
201 TTCAGACGGC ATTCTGCTGC CGACGGAGA ACGCCTGACA CCGTTCGGCA
```

-continued

```
 251 AAAAACTGCG TGCCGCCAGT TTGGACGAAC TGCCCGAACT GTGGAACGTC
 301 CTCAAAGGCG ACATGAGCCT GGTCGGCCCC CGCCCGCTGC TGATGCAATA
 351 TCTGCCGCTG TACGACAACT TCCAAAACCG CCGCCACGAA ATGAAACCGG
 401 GCATTACCGG CTGGGCGCAG GTCAACGGGC GCAACGCGCT TTCGTGGGAC
 451 GAACGCTTCG CATGCGACAT CTGGTATATC GACCACTTCA GCCTGTGCCT
 501 CGACATCAAA ATCCTACTGC TGACGGTTAA AAAAGTATTA ATCAAAGAAG
 551 GGATTTCCGC ACAGGGCGAA GCCACCATGC CCCCTTTCAC AGGAAAACGC
 601 AAACTTGCCG TCGTCGGTGC GGGCGGACAC GGCAAAGTCG TTGCCGAGCT
 651 TGCCGCCGCA CTCGGCACAT ACGGCGAAAT CGTTTTTCTG GACGACCGCG
 701 TCCAAGGCAG CGTCAACGGC TTCCCCGTCA TCGGCACGAC GCTGCTGCTT
 751 GAAAACAGTT TATCGCCCGA ACAATTCGAC ATCGCCGTCG CCGTCGGCAA
 801 CAACCGCATC CGCCGCCAAA TCGCCGAAAA AGCCGCCGCG CTCGGCTTCG
 851 CCCTGCCCGT CCTGATTCAT CCGGACTCGA CCGTCTCGCC TTCTGCAACA
 901 GTCGGACAAG GCGGCGTCGT TATGGCGAAA GCCGTCGTAC AGGCTGACAG
 951 CGTATTGAAA GACGGCGTAA TTGTGAACAC TGCCGCCACC GTCGATCACG
1001 ATTGCCTGCT TGATGCTTTC GTCCACATCA GCCCGGGCGC GCACCTGTCG
1051 GGCAACACGC GTATCGGCGA AGAAAGCTGG ATAGGCACAG GCGCGTGCAG
1101 CCGCCAGCAG ATCCGTATCG GCAGCCGCGC AACCATTGGA GCGGGCGCAG
1151 TCGTCGTGCG CGACGTTTCA GACGGCATGA CCGTCGCGGG CAACCCGGCA
1201 AAACCATTGG CAGGCAAAAA TACCGAGACC CTGCGGTCGT AA
```

This is predicted to encode a protein having amino acid sequence <SEQ ID 16>:

```
  1 MSKFFKRLFD IVASASGLIF LSPVFLILIY LIRKNLGSPV FFFQERPGKD
 51 GKPFKMVKFR SMHDALDSDG ILLPDGERLT PFGKKLRAAS LDELPELWNV
101 LKGDMSLVGP RPLLMQYLPL YDNFQNRRHE MKPGITGWAQ VNGRNALSWD
151 ERFACDIWYI DHFSLCLDIK ILLLTVKKVL IKEGISAQGE ATMPPFTGKR
201 KLAVVGAGGH GKVVAELAAA LGTYGEIVFL DDRVQGSVNG FPVIGTTLLL
251 ENSLSPEQFD IAVAVGNNRI RRQIAEKAAA LGFALPVLIH PDSTVSPSAT
301 VGQGGVVMAK AVVQADSVLK DGIVVNTAAT VDHDCLLDAF VHISPGAHLS
351 GNTRIGEESW IGTGACSRQQ IRIGSRATIG AGAVVVRDVS DGMTVAGNPA
401 KPLAGKNTET LRS*
```

Two transmembrane domains are underlined.
ORF3-1 shows 94.6% identity in 410 aa overlap with ORF3a:

```
                  10        20        30        40        50        60
orf3a.pep  MSKFFKRLFDIVASASGLIFLSPVFLILIYLIRKNLGSPVFFFQERPGKDGKPFKMVKFR
           ||||||||||||||||||||||||||||||||||||||||||||||||||||||||||||
orf3-1     MSKFFKRLFDIVASASGLIFLSPVFLILIYLIRKNLGSPVFFFQERPGKDGKPFKMVKFR
                  10        20        30        40        50        60
```

-continued

```
                70         80         90        100        110        120
orf3a.pep  SMHDALDSDGILLPDGERLTPFGKKLRAASLDELPELWNVLKGDMSLVGPRPLLMQYLPL
           ||:||||||||:|||||||||||||||||:|||||||||:|||:||||||||||||||
orf3-1     SMRDALDSDGIPLPDGERLTPFGKKLRAASLDELPELWNILKGEMSLVGPRPLLMQYLPL
                70         80         90        100        110        120
               130        140        150        160        170        180
orf3a.pep  YDNFQNRRHEMKPGITGWAQVNGRNALSWDERFACDIWYIDHFSLCLDIKILLLTVKKVL
           ||||||||||||||||||||||||||||||||:|||||:||||||||||||||||||||
orf3-1     YDNFQNRRHEMKPGITGWAQVNGRNALSWDEKFACDVWYIDHFSLCLDIKILLLTVKKVL
               130        140        150        160        170        180
               190        200        210        220        230        240
orf3a.pep  IKEGISAQGEATMPPFTGKRKLAVVGAGGHGKVVAELAAALGTYGEIVFLDDRVQGSVNG
           |||||||||||||||||||||||||||||||||:|||||||||:|||||||||:|||||
orf3-1     IKEGISAQGEATMPPFTGKRKLAVVGAGGHGKVVADLAAALGRYREIVFLDDRAQGSVNG
               190        200        210        220        230        240
               250        260        270        280        290        300
orf3a.pep  FPVIGTTLLLENSLSPEQFDIAVAVGNNRIRRQIAEKAAALGFALPVLIHPDSTVSPSAT
           |:||||||||||||||||:|:|||||||||||||||||||||||||||:|||:||||||
orf3-1     FSVIGTTLLLENSLSPEQYDVAVAVGNNRIRRQIAEKAAALGFALPVLVHPDATVSPSAT
               250        260        270        280        290        300
               310        320        330        340        350        360
orf3a.pep  VGQGGVVMAKAVVQADSVLKDGVIVNTAATVDHDCLLDAFVHISPGAHLSGNTRIGEESW
           ||||:|||||||||||:||||||||||||||||||||:||||||||||||||:|||||||
orf3-1     VGQGSVVMAKAVVQAGSVLKDGVIVNTAATVDHDCLLNAFVHISPGAHLSGNTHIGEESW
               310        320        330        340        350        360
               370        380        390        400        410
orf3a.pep  IGTGACSRQQIRIGSRATIGAGAVVVRDVSDGMTVAGNPAKPLAGKNTETLRSX
           |||||||||||||||||||||||||||||||||||||||||||:||:|||:||
orf3-1     IGTGACSRQQIRIGSRATIGAGAVVVRDVSDGMTVAGNPAKPLPRKNPETSTAX
               370        380        390        400        410
```

Homology with Hypothetical Protein Encoded by yvfc Gene (Accession Z71928) of *B. subtilis*

ORF3 and YVFC proteins show 55% aa identity in 170 aa overlap (BLASTp):

```
ORF3    3  IYLIRKNLGSPVFFFQERPGKDGKPFKMVKFRSMRDGLYSDGIPLPDGERLTPFGKKLRA   62
           I ++R +GSPVFF Q RPG GKPF + KFR+M D    S G  LPD RLT  G+ +R
yvfc   27  IAVVRLKIGSPVFFKQVRPGLHGKPFTLYKFRTMTDERDSKGNLLPDEVRLTKTGRLIRK   86

ORF3   63  ASXDELPELWNILKGEMSLVGPRPLLMQYLPLYDNFQNRRHEMKPGITGWAQVNGRNALS  122
           S DELP+L N+LKG++SLVGPRPLLM YLPLY   Q RRHE+KPGITGWAQ+NGRNA+S
yvfc   87  LSIDELPQLLNVLKGDLSLVGPRPLLMDYLPLYTEKQARRHEVKPGITGWAQINGRNAIS  146

ORF3  123  WDEKFACDVWYIDHFSLCLDXXXXXXXXXXXXXXXEGISAQGEXTMPPFTG           172
           W++KF  DVWY+D++S  LD               EGI    T  FTG
yvfc  147  WEKKFELDVWYVDNWSFFLDLKILCLTVRKVLVSEGIQQTNHVTAERFTG            196
```

Homology with a Predicted ORF from *N. gonorrhoeae*

ORF3 shows 86.3% identity over a 286aa overlap with a predicted ORF (ORF3.ng) from *N. gonorrhoeae*:

```
orf3                                 ILIYLIRKNLGSPVFFFQERPGKDGKPFKMVKFR   34
                                     :|||||||||:||||||||::|||||||||||||
orf3ng  MSKAVKRLFDIIASASGLIVLSPVFLVLIYLIRKNKGSPVFFIRERPGKDGKPFKMVKFR   60 orf3    SMRDGLYSDGIPLPDGERLTPFGKKLRAASXDELPELWNILKGEMSLVGPRPLLMQYLPL   94
        ||||:|||||||||||:||||||||||||: ||||||||||:|||||||||||||||||
orf3ng  SMRDALDSDGIPLPDSERLTDFGKKLRATSLDELPELWNVLKGEMSLVGPRPLLMQYLPL  120 orf3    YDNFQNRRHEMKPGITGWAQVNGRNALSWDEKFACDVWYIDHFSLCLDIKILLLTVKKVL  154
        |::|||||||||||||||||||||||||||||:|||||||:|||:||:|||:||||||||
orf3ng  YNKFQNRRHEMKPGITGWAQVNGRNALSWDEKFSCDVWYTDNFSFWLDMKILFLTVKKVL  180 orf3    IKEGISAQGEXTMPPFTGKRKLAVVGAGGHGKVVADLAAALGRYREIVFLDDRAQGSVNG  214
        ||||||||||:|||||:||||:||||||||||||||:|||||||:|||||||||:|||||
orf3ng  IKEGISAQGEATMPPFAGNRKLAVIGAGGHGKVVAELAAALGTYGEIVFLDDRTQGSVNG  240 orf3    FSVIGTTLLLENSLSPEQYDVAVAVGNNRIRRQIAEKAAALGFALPVLVHPDATVSPSAT  274
        |:||||||||||||||||:|:||||||||||||||::|||||:|||||:|||||||||:
orf3ng  FPVIGTTLLLENSLSPEQFDITVAVGNNRIRRQITENAAALGFKLPVLIHPDATVSPSAI  300 orf3    VGQGSVVMAKAV                                                 286
        :||||||||||||
orf3ng  IGQGSVVMAKAVVQAGSVLKDGVIVNTAATVDHDCLLDAFVHISPGAHLSGNTRIGEESR  360
```

The complete length ORF3ng nucleotide sequence <SEQ ID 17> is:

```
   1 ATGAGTAAAG CCGTCAAACG CCTGTTCGAC ATCATCGCAT CCGCATCGGG
  51 GCTGATTGTC CTGTCGCCCG TGTTTTTGGT TTTAATATAC CTCATCCGCA
 101 AAAACTTAGG TTCGCCCGTC TTCTTCattC GGGAACGCCc cgGAAAGGAc
 151 ggaaaacCTT TTAAAATGGT CAAATTCCGT TCCAtgcgcg acgcgcttGA
 201 TTCAGACGGC ATTCCGCTGC CCGATAGCGA ACGCCTGACC GATTTCGGCA
 251 AAAAATTACG CGCCACCAGT TTGGACGAAC TTCCTGAATT ATGGAATGTC
 301 CTCAAAGGCG AGATGAGCCT GGTCGGCCCC CGCCCGCTTT TGATGCAGTA
 351 TCTGCCGCTT TACAACAAAT TCAAAACCG CCGCCACGAA ATGAAACCGG
 401 GCATTACCGG CTGGGCGCAG GTCAACGGGC GCAACGCGCT TTCGTGGGAC
 451 GAAAAGTTCT CCTGCGATGT TTGGTACACC GACAATTTCA GCTTTTGGCT
 501 GGATATGAAA ATCCTGTTTC TGACAGTCAA AAAAGTCTTG ATTAAAGAAG
 551 GCATTTCGGC GCAAGGGGAA GCCACCATGC CCCCTTTCGC GGGGAATCGC
 601 AAACTCGCCG TTATCGGCGC GGGCGGACAC GGCAAAGTCG TTGCCGAGCT
 651 TGCCGCCGCA CTCGGCACAT ACGGCGAAAT CGTTTTTCTG GACGACCGCA
 701 CCCAAGGCAG CGTCAACGGC TTCCCCGTCA TCGGCACGAC GCTGCTGCTT
 751 GAAAACAGTT TATCGCCCGA ACAATTCGAC ATCACCGTCG CCGTCGGCAA
 801 CAACCGCATC CGCCGCCAAA TCACCGAAAA CGCCGCCGCG CTCGGCTTCA
 851 AACTGCCCGT TCTGATTCAT CCCGACGCGA CCGTCTCGCC TTCTGCAATA
 901 ATCGGACAAG GCAGCGTCGT AATGGCGAAA GCCGTCGTAC AGGCCGGCAG
 951 CGTATTGAAA GACGGCGTGA TTGTGAACAC TGCCGCCACC GTCGATCACG
1001 ACTGCCTGCT TGACGCTTTC GtccaCATCA GCCCGGGCGC GCACCTGTCG
1051 GGCAACACGC GTATCCGCGA AGAAAGCCGG ATAGGCACGG GCGCGTGCAG
1101 CCGCCAGCAG ACAACCGTCG GCAGCGGGGT TACCgccgGT GCAGGGgcGG
1151 TTATCGTATG CGACATCCCG GACGGCATGA CCGTCGCGGG CAACCCGGCA
1201 AAGCCCCTTA CGGGCAAAAA CCCCAAGACC GGGACGGCAT AA
```

This encodes a protein having amino acid sequence <SEQ ID 18>:

```
  1 MSKAVKRLFD IIASASGLIV LSPVFLVLIY LIRKNLGSPV FFIRERPGKD
 51 GKPFKMVKFR SMRDALDSDG IPLPDSERLT DFGKKLRATS LDELPELWNV
101 LKGEMSLVGP RPLLMQYLPL YNKFQNRRHE MKPGITGWAQ VNGRNALSWD
151 EKFSCDVWYT DNFSFWLDMK ILFLTVKKVL IKEGISAQGE ATMPPFAGNR
201 KLAVIGAGGH GKVVAELAAA LGTYGEIVFL DDRTQGSVNG FPVIGTTLLL
251 ENSLSPEQFD ITVAVGNNRI RRQITENAAA LGFKLPVLIH PDATVSPSAI
301 IGQGSVVMAK AVVQAGSVLK DGIVVNTAAT VDHDCLLDAF VHISPGAHLS
351 GNTRIGEESR IGTGACSRQQ TTVGSGVTAG AGAVIVCDIP DGMTVAGNPA
401 KPLTGKNPKT GTA*
```

This protein shows 86.9% identity in 413 aa overlap with ORF3-1:

```
                  10        20        30        40        50        60
orf3-1.pep  MSKFFKRLFDIVASASGLIFLSPVFLILIYLIRKNLGSPVFFFQERPGKDGKPFKMVKFR
            |||   ||||||:|||||:|||||||:||||||||||||||::|||||||||||||||||
orf3ng      MSKAVKRLFDIIASASGLIVLSPVFLVLIYLIRKNLGSPVFFIRERPGKDGKPFKMVKFR
                  10        20        30        40        50        60

70        80        90       100       110       120
orf3-1.pep  SMRDALDSDGIPLPDGERLTPFGKKLRAASLDELPELWNILKGEMSLVGPRPLLMQYLPL
            |||||||||||||||:|||||:||||||:|||||||||||:|||||||||||||||||||
orf3ng      SMRDALDSDGIPLPDSERLTDFGKKLRATSLDELPELWNVLKGEMSLVGPRPLLMQYLPL
                  70        80        90       100       110       120

130       140       150       160       170       180
orf3-1.pep  YDNFQNRRHEMKPGITGWAQVNGRNALSWDEKFACDVWYIDHFSLCLDIKILLLTVKKVL
            |::|||||||||||||||||||||||||||||:|||||||:|||:||:||:|||:|||||
orf3ng      YNKFQNRRHEMKPGITGWAQVNGRNALSWDEKFSCDVWYTDNFSFWLDMKILFLTVKKVL
                 130       140       150       160       170       180

190       200       210       220       230       240
orf3-1.pep  IKEGISAQGEATMPPFTGKRKLAVVGAGGHGKVADLAAALGRYREIVFLDDRAQGSVNG
            |||||||||||||||||:|:|||||:||||||||:|||||||:|||:||||||:|||||
orf3ng      IKEGISAQGEATMPPFAGNRKLAVIGAGGHGKVVAELAAALGTYGEIVFLDDRTQGSVNG
                 190       200       210       220       230       240

250       260       270       280       290       300
orf3-1.pep  FSVIGTTLLLENSLSPEQYDVAVAVGNNRIRRQIAEKAAALGFALPVLVHPDATVSPSAT
            |:||||||||||||||||:||:|||||||||||:||:|||||||:|||:||||||||||:
orf3ng      FPVIGTTLLLENSLSPEQFDITVAVGNNRIRRQITENAAALGFKLPVLIHPDATVSPSAI
                 250       260       270       280       290       300

310       320       330       340       350       360
orf3-1.pep  VGQGSVVMAKAVVQAGSVLKDGVIVNTAATVDHDCLLNAFVHISPGAHLSGNTHIGEESW
            :|||||||||||||||||||||||||||||||||||:|||||||||||||||||:|||:|
orf3ng      IGQGSVVMAKAVVQAGSVLKDGVIVNTAATVDHDCLLDAFVHISPGAHLSGNTRIGEESR
                 310       320       330       340       350       360

370       380       390       400       410
orf3-1.pep  IGTGACSRQQIRIGSRATIGAGAVVVRDVSDGMTVAGNPAKPLPRKNPETSTAX
            ||||||||||::||:|::||||||:|:|:||||||||||||||:||||:|:|||
orf3ng      IGTGACSRQQTTVGSGVTAGAGAVIVCDIPDGMTVAGNPAKPLTGKNPKTGTAX
                 370       380       390       400       410
```

In addition, ORF3ng shows significant homology with a hypothetical protein from *B. subtilis*:

```
gnl|PID|e238668 (Z71928) hypothetical protein [Bacillus subtilis]
>gi|1945702|gnl|PID|e313004 (Z94043) hypothetical protein [Bacillus
subtilis]
>gi|2635938|gnl|PID|e1186113 (Z99121) similar to capsular polysaccharide
biosynthesis [Bacillus subtilis]Length = 202
 Score = 235 bits (594), Expect = 3e-61
 Identities = 114/195 (58%), Positives = 142/195 (72%)
Query:   5 VKRLFDIIASASGLIVLSPVFLVLIYLIRKNLGSPVFFIRERPGKDGKPFKMVKFRSMRD  64
           +KRLFD+ A+    L  S + L  I ++R  +GSPVFF + RPG  GKPF  + KFR+M D
Sbjct:   3 LKRLFDLTAAIFLLCCTSVIILFTIAVVRLKIGSPVFFKQVRPGLHGKPFTLYKFRTMTD  62

Query:  65 ALDSDGIPLPDSERLTDFGKKLRATSLDELPELWNVLKGEMSLVGPRPLLMQYLPLYNKF 124
              DS G  LPD  RLT  G+ +R   S+DELP+L NVLKG++SLVGPRPLLM YLPLY +
Sbjct:  63 ERDSKGNLLPDEVRLTKTGRLIRKLSIDELPQLLNVLKGDLSLVGPRPLLMDYLPLYTEK 122

Query: 125 QNRRHEMKPGITGWAQVNGRNALSWDEKFSCDVWYTDNFSFWLDMKILFLTVKKVLIKEG 184
           Q RRHE+KPGITGWAQ+NGRNA+SW++KF  DVWY DN+SF LD+KIL LTV+KVL+ EG
Sbjct: 123 QARRHEVKPGITGWAQINGRNAISWEKKFELDVWYVDNWSFFLDLKILCLTVRKVLVSEG 182

Query: 185 ISAQGEATMPPFAGN                                             199
           I    T   F G+
Sbjct: 183 IQQTNHVTAERFTGS                                             197
```

The hypothetical product of yvfc gene shows similarity to EXOY of *R. meliloti*, an exopolysaccharide production protein. Based on this and on the two predicted transmembrane regions in the homologous *N. gonorrhoeae* sequence, it is predicted that these proteins, or their epitopes, could be useful antigens for vaccines or diagnostics, or for raising antibodies.

Example 4

The following partial DNA sequence was identified in *N. meningitidis* <SEQ ID 19>:

```
  1...AACCATATGG CGATTGTCAT CGACGAATAC GGCGGCACAT
     CCGGCTTGGT
 51   CACCTTTGAA GACATCATCG AGCAAATCGT CGGCGAAATC
     GAAGACGAGT
101   TTGACGAAGA CGATAGCGCC GACAATATCC ATGCCGTTTC
     TTCAGACACG
151   TGGCGCATCC ATGCAGCTAC CGAAATCGAA GACATCAACA
     CCTTCTTCGG
201   CACGGAATAC AGCATCGAAG AAGCCGACAC CATT.GGCGG
     CCTGGTCATT
251   CAAGAGTTGG GACATCTGCC CGTGCGCGGC GAAAAAGTCC
     TTATCGGCGG
301   TTTGCAGTTC ACCGTCGCAC GCGCCGACAA CCGCCGCCTG
     CATACGCTGA
351   TGGCGACCCG CGTGAAGTAA GC........ .....ACCGC
     CGTTTCTGCA
401   CAGTTTAG
```

This corresponds to amino acid sequence <SEQ ID 20; ORF5>:

```
  1...NHMAIVIDEY GGTSGLVTFE DIIEQIVGEI EDEFDEDDSA
     DNIHAVSSDT
 51   WRIHAATEIE DINTFFGTEY SIEEADTIXR PGHSRVGTSA
     RARRKSPYRR
101   FAVHRRTRRQ PPPAYADGDP REVS....XR RFCTV*
```

Further sequence analysis revealed the complete DNA sequence to be <SEQ ID 21>:

```
  1 ATGGACGGCG CACAACCGAA AACGAATTTT TTTGAACCCC
     TGATTGCCCG
 51 ACTCGCCCGC GAACCCGATT CCGCCGAAGA CGTATTAAAC
     CTGCTTCGGC
101 AGGCGCACGA GCAGGAAGTT TTTGATGCGG ATACGCTTTT
     AAGATTGGAA
151 AAAGTCCTCG ATTTTTCCGA TTTGGAAGTG CGCGACGCGA
     TGATTACGCG
201 CAGCCGTATG AACGTTTTAA AAGAAAACGA CAGCATCGAG
     CGCATCACCG
251 CCTACGTTAT CGATACCGCC CATTCGCGCT TCCCCGTCAT
     CGGCGAAGAC
301 AAAGACGAAG TTTTGGGCAT TTTGCACGCC AAAGACCTGC
     TCAAATATAT
351 GTTTAACCCC GAGCAGTTCC ACCTCAAATC CATTCTCCGC
     CCCGCCGTCT
401 TCGTCCCCGA AGGCAAATCG CTGACCGCCC TTTTAAAAGA
     GTTCCGCGAA
451 CAGCGCAACC ATATGGCGAT TGTCATCGAC GAATACGGCG
     GCACATCCGG
501 CTTGGTCACC TTTGAAGACA TCATCGAGCA AATCGTCGGC
     GAAATCGAAG
551 ACGAGTTTGA CGAAGACGAT AGCGCCGACA ATATCCATGC
     CGTTTCTTCC
601 GAACGCTGGC GCATCCATGC AGCTACCGAA ATCGAAGACA
     TCAACACCTT
651 CTTCGGCACG GAATACAGCA GCGAAGAAGC CGACACCATT
     CGGCCTGGTC
701 ATTCAAGAGT TGGCACATCT GCCCGTGCGC GGCGAAAAAG
     TCCTTATCGG
751 CGGTTTGCAG TTCACCGTCG CACGCGCCGA CAACCGCCGC
     CTGCATACGC
801 TGATGGCGAC CCGCGTGAAG TAAGCACCGC CGTTTCTGCA
     CAGTTTAGGA
851 TGACGGTACG GGCGTTTTCT GTTTCAATCC GCCCCATCCG
     CCAAACATAA
```

This corresponds to amino acid sequence <SEQ ID 22; ORF5-1>:

```
  1 MDGAQPKTNF FERLIARLAR EPDSAEDVLN LLRQAHEQEV FDADTLLRLE
 51 KVLDFSDLEV RDAMITRSRM NVLKENDSIE RITAYVIDTA HSRFPVIGED
101 KDEVLGILHA KDLLKYMFNP EQFHLKSILR PAVFVPEGKS LTALLKEFRE
151 QRNHMAIVID EYGGTSGLVT FEDIIEQIVG EIEDEFDEDD SADNIHAVSS
201 ERWRIHAATE IEDINTFFGT EYSSEEADTI RPGHSRVGTS ARARRKSPYR
251 RFAVHRRTRR QPPPAYADGD PREVSTAVSA QFRMTVRAFS VSIRPIRQT*
```

Further work identified the corresponding gene in strain A of *N. meningitidis* <SEQ ID 23>:

```
  1 ATGGACGGCG CACAACCGAA AACAAATTTT TTNNAACGCC TGATTGCCCG
 51 ACTCGCCCGC GAACCCGATT CCGCCGAAGA CGTATTGACC CTGTTGCGCC
101 AAGCGCACGA ACAGGAAGTA TTTGATGCGG ATACGCTTTT AAGATTGGAA
151 AAAGTCCTCG ATTTTTCTGA TTTGGAAGTG CGCGACGCGA TGATTACGCG
201 CAGCCGTATG AACGTTTTAA AAGAAAACGA CAGCATCGAA CGCATCACCG
251 CCTACGTTAT CGATACCGCC CATTCGCGCT TCCCCGTCAT CGGTGAAGAC
301 AAAGACGAAG TTTTGGGTAT TTTGCACGCC AAAGACCTGC TCAAATATAT
351 GTTCAACCCC GAGCAGTTCC ACCTCAAATC GATATTGCGC CCTGCCGTCT
401 TCGTCCCCGA AGGCAAATCG CTGACCGCCC TTTTAAAAGA GTTCCGCGAA
451 CAGCGCAACC ATATGGCAAT CGTCATCGAC GAATACGGCG GCACGTCGGG
501 TTTGGTAACT TTTGAAGACA TCATCGAGCA AATCGTCGGC GACATCGAAG
551 ATGAGTTTGA CGAAGACGAA AGCGCGGACA ACATCCACGC CGTTTCCGCC
601 GAACGCTGGC GCATCCACGC GGCTACCGAA ATCGAAGACA TCAACGCCTT
651 TTTCGGCACG GAATACAGCA GCGAAGAAGC CGACACCATC GGCGGCCNTG
701 GTCATTCAGG AATTGGNACA CCTGCCCGTG CGCGGCGAAA AAGTCNTTAT
751 CGGCGNNTTG CANTTCACNG TCGCCNGCGC NGACAACCGC CGCCTGCATA
801 CGCTGATGGC GACCCGCGTG AAGTAAGCTC CGCCGTTTCT GTACAGTTTA
851 GGATGACGGT ACGGGCGTTT TCTGTTTCAA TCCGCCCCAT CCGCCANACA
901 TAA
```

This encodes a protein having amino acid sequence <SEQ ID 24; ORF5a>:

```
  1 MDGAQPKTNF XXRLIARLAR EPDSAEDVLT LLRQAHEQEV FDADTLLRLE
 51 KVLDFSDLEV RDAMITRSRM NVLKENDSIE RITAYVIDTA HSRFPVIGED
101 KDEVLGILHA KDLLKYMFNP EQFHLKSILR PAVFVPEGKS LTALLKEFRE
151 QRNHMAIVID EYGGTSGLVT FEDIIEQIVG DIEDEFDEDE SADNIHAVSA
201 ERWRIHAATE IEDINAFFGT EYSSEEADTI GGXGHSGIGT PARARRKSXY
251 RRXAXHXRXR XQPPPAYADG DPREVSSAVS VQFRMTVRAF SVSIRPIRXT
301 *
```

The originally-identified partial strain B sequence (ORF5) shows 54.7% identity over a 124aa overlap with ORF5a:

```
                                                      10        20        30
orf5.pep                                NHMAIVIDEYGGTSGLVTFEDIIEQIVGEI
                                        ||||||||||||||||||||||||||||:|
orf5a         FHLKSILRPAVFVPEGKSLTALLKEFREQRNHMAIVIDEYGGTSGLVTFEDIIEQIVGDI
                   130       140       150       160       170       180

40        50        60        70        80        90
orf5.pep      EDEFDEDDSADNIHAVSSDTWRIHAATEIEDINTFFGTEYSIEEADTIXRPGHSRVGTSA
              |||||||:|||||||||:: |||||||||||||:||||||| ||||||   ||| :|| |
orf5a         EDEFDEDESADNIHAVSAERWRIHAATEIEDINAFFGTEYSSEEADTIGGXGHSGIGTPA
                     190       200       210       220       230       240
```

-continued

```
                      100        110        120        130
orf5.pep    RARRKSPYRRFAVHRRTRRQPPPAYADGDPREVSXXXXXRRFCTV
            ||||||  ||| |  |  | ||||||||||||||||     ||||||
orf5a       RARRKSXYRRXAXHXRXRXQPPPAYADGDPREVSSAVSVQFRMTVRAFSVSIRPIRXTX
                      250        260        270        280        290        300
```

The complete strain B sequence (ORF5-1) and ORF5a show 92.7% identity in 300 aa overlap:

```
                  10        20        30        40        50        60
orf5a.pep    MDGAQPKTNFXXRLIARLAREPDSAEDVLTLLRQAHEQEVFDADTLLRLEKVLDFSDLEV
             |||||||||  |||||||||||||||||| ||||||||||||||||||||||||||||||
orf5-1       MDGAQPKTNFFERLIARLAREPDSAEDVLNLLRQAHEQEVFDADTLLRLEKVLDFSDLEV
                  10        20        30        40        50        60
                  70        80        90       100       110       120
orf5a.pep    RDAMITRSRMNVLKENDSIERITAYVIDTAHSRFPVIGEDKDEVLGILHAKDLLKYMFNP
             ||||||||||||||||||||||||||||||||||||||||||||||||||||||||||||
orf5-1       RDAMITRSRMNVLKENDSIERITAYVIDTAHSRFPVIGEDKDEVLGILHAKDLLKYMFNP
                  70        80        90       100       110       120
                 130       140       150       160       170       180
orf5a.pep    EQFHLKSILRPAVFVPEGKSLTALLKEFREQRNHMAIVIDEYGGTSGLVTFEDIIEQIVG
             ||||||||||||||||||||||||||||||||||||||||||||||||||||||||||||
orf5-1       EQFHLKSILRPAVFVPEGKSLTALLKEFREQRNHMAIVIDEYGGTSGLVTFEDIIEQIVG
                 130       140       150       160       170       180
                 190       200       210       220       230       240
orf5a.pep    DIEDEFDEDESADNIHAVSAERWRIHAATEIEDINAFFGTEYSSEEADTIGGXGHSGIGT
             :||||||||| ||||||||:|||||||||||||| ||||||| |||||||||   : ||
orf5-1       EIEDEFDEDDSADNIHAVSSERWRIHAATEIEDINTFFGTEYSSEEADTIRP-GHSRVGT
                 190       200       210       220       230
                 250       260       270       280       290       300
orf5a.pep    PARARRKSXYRRXAXHXRXRXQPPPAYADGDPREVSSAVSVQFRMTVRAFSVSIRPIRXT
             |||||||| ||| |  |  | ||||||||||||||| ||:|||||||||||||||||| |
orf5-1       SARARRKSPYRRFAVHRRTRRQPPPAYADGDPREVSTAVSAQFRMTVRAFSVSIRPIRQT
                 240       250       260       270       280       290
```

Further work identified the a partial DNA sequence in *N. gonorrhoeae* <SEQ ID 25> which encodes a protein having amino acid sequence <SEQ ID 26; ORF5ng>:

```
  1 MDGAQPKTNF FERLIARLAR EPDSAEDVLN LLRQAHEQEV FDADTLTRLE
 51 KVLDFAELEV RDAMITRSRM NVLKENDSIE RITAYVIDTA HSRFPVIGED
101 KDEVLGILHA KDLLKYMFNP EQFHLKSVLR PAVFVPEGKS LTALLKEFRE
151 QRNHMAIVID EYGGTSGLVT FEDIIEQIVG DIEDEFDEDE SADDIHSVSA
201 ERWRIHAATE IEDINAFFGT EYGSEEADTI RRLGHSGIGT PARARRKSPY
251 RRFAVHRRPR RQPPPAHADG DPREVSRACP HRRFCTV*
```

Further analysis revealed the complete gonococcal nucleotide sequence <SEQ ID 27> to be:

```
  1 ATGGACGGCG CACAACCGAA ACAAATTTT TTTGAACGCC TGATTGCCCG
 51 ACTCGCCCGC GAACCCGATT CCGCCGAAGA CGTATTAAAC CTGCTTCGGC
101 AGGCGCACGA ACAGGAAGTT TTTGATGCCG ACACACTGAC CCGGCTGGAA
151 AAAGTATTGG ACTTTGCCGA GCTGGAAGTG CGCGATGCGA TGATTACGCG
201 CAGCCGCATG AACGTATTGA AAGAAAACGA CAGCATCGAA CGCATCACCG
251 CCTACGTCAT CGATACCGCC CATTCGCGCT TCCCCGTCAT CGGCGAAGAC
301 AAAGACGAAG TTTTGGGCAT TTTGCACGCC AAAGACCTGC TCAAATATAT
351 GTTCAACCCC GAGCAGTTCC ACCTGAAATC CGTCTTGCGC CCTGCCGTTT
```

-continued

```
401 TCGTGCCCGA AGGCAAATCT TTGACCGCCC TTTTAAAAGA GTTCCGCGAA
451 CAGCGCAACC ATATGGCAAT CGTCATCGAC GAATACGGCG GCACGTCGGG
501 TTTGGTCACC TTTGAAGACA TCATCGAGCA AATCGTCGGT GACATCGAAG
551 ACGAGTTTGA CGAAGACGAA AGCGccgacg acatCCACTC cgTTTccgCC
601 GAACGCTGGC GCATCCacgc ggctaCCGAA ATCGAAGaca TCAACGCCTT
651 TTTCGGTACG GAatacggca gcgaagaagc cgacaccatc cggcggctTG
701 GTCATTCAGG AATTGGGACA CCTGCCCGTG CGCGGCGAAA AAGTCCTTAt
751 cggcgGTTTG Cagttcaccg tCGCCCGCGC CGACAACCGC CGCCTGCACA
801 CGCTGATGGC GACCCGCGTG AAGTAAGCAG AGCCTGCCcg AccgccgttT
851 CTGCacAGTT TAGGatgACG gtaCGGTCGT TTTCTGTTTC AATCCGCCCC
901 ATCCGCCAAA CATAA
```

This encodes a protein having amino acid sequence <SEQ ID 28; ORF5ng-1>:

```
  1 MDGAQPKTNF FERLIARLAR EPDSAEDVLN LLRQAHEQEV FDADTLTRLE
 51 KVLDFAELEV RDAMITRSRM NVLKENDSIE RITAYVIDTA HSRFPVIGED
101 KDEVLGILHA KDLLKYMFNP EQFHLKSVLR PAVFVPEGKS LTALLKEFRE
151 QRNHMAIVID EYGGTSGLVT FEDIIEQIVG DIEDEFDEDE SADDIHSVSA
201 ERWRIHAATE IEDINAFFGT EYGSEEADTI RRLGHSGIGT PARARRKSPY
251 RRFAVHRRPR RQPPPAHADG DPREVSRACP TAVSAQFRMT VRSFSVSIRP
301 IRQT*
```

The originally-identified partial strain B sequence (ORF5) shows 83.1% identity over a 135aa overlap with the partial gonococcal sequence (ORF5ng):

```
orf5                          NHMAIVIDEYGGTSGLVTFEDIIEQIVGEI    30
                              |||||||||||||||||||||||||||||:|
orf5ng  FHLKSVLRPAVFVPEGKSLTALLKEFREQRNHMAIVIDEYGGTSGLVTFEDIIEQIVGDI   182
orf5    EDEFDEDDSADNIHAVSSDTWRIHAATEIEDINTFFGTEYSIEEADTIXRPGHSRVGTSA    90
        ||||||:|||:||:|| :: |||||||||||||:|: ||||| ||:| ||| :|| ||
orf5ng  EDEFDEDESADDIHSVSAERWRIHAATEIEDINAFFGTEYGSEEADTIRRLGHSGIGTPA   242
orf5    RARRKSPYRRFAVHRRTRRQPPPAYADGDPREVSX----RRFCTV   131
        ||||||||||||||||:||||||||:|||||||||    |||||
orf5ng  RARRKSPYRRFAVHRRPRRQPPPAHADGDPREVSRACPHRRFCTV   287
```

The complete strain B and gonococcal sequences (ORF5-1 & ORF5ng-1) show 92.4% identity in 304 aa overlap:

```
                    10         20         30         40         50         60
orf5ng-1.pep  MDGAQPKTNFFERLIARLAREPDSAEDVLNLLRQAHEQEVFDADTLTRLEKVLDFAELEV
              |||||||||||||||||||||||||||||||||||||||||||||| ||||||::|||
orf5-1        MDGAQPKTNFFERLIARLAREPDSAEDVLNLLRQAHEQEVFDADTLLRLEKVLDFSDLEV
                    10         20         30         40         50         60

70         80         90        100        110        120
orf5ng-1.pep  RDAMITRSRMNVLKENDSIERITAYVIDTAHSRFPVIGEDKDEVLGILHAKDLLKYMFNP
              ||||||||||||||||||||||||||||||||||||||||||||||||||||||||||||
orf5-1        RDAMITRSRMNVLKENDSIERITAYVIDTAHSRFPVIGEDKDEVLGILHAKDLLKYMFNP
                    70         80         90        100        110        120
```

```
                       130       140       150       160       170       180
orf5ng-1.pep   EQFHLKSVLRPAVFVPEGKSLTALLKEFREQRNHMAIVIDEYGGTSGLVTFEDIIEQIVG
               ||||||||:|||||||||||||||||||||||||||||||||||||||||||||||||||
orf5-1         EQFHLKSILRPAVFVPEGKSLTALLKEFREQRNHMAIVIDEYGGTSGLVTFEDIIEQIVG
                       130       140       150       160       170       180
                       190       200       210       220       230       240
orf5ng-1.pep   DIEDEFDEDESADDIHSVSAERWRIHAATEIEDINAFFGTEYGSEEADTIRRLGHSGIGT
               :|||||||||:|||:||:|:||||||||||||||:|||||||:||||||||| ||| ||
orf5-1         EIEDEFDEDDSADNIHAVSSERWRIHAATEIEDINTFFGTEYSSEEADTIRP-GHSRVGT
                       190       200       210       220       230
                       250       260       270       280       290       300
orf5ng-1.pep   PARARRKSPYRRFAVHRRPRRQPPPAHADGDPREVSRACPTAVSAQFRMTVRSFSVSIRP
               |||||||||||||||||||:|||||||:|||||||||    ||||||||||||:|||||
orf5-1         SARARRKSPYRRFAVHRRTRRQPPPAYADGDPREVS----TAVSAQFRMTVRAFSVSIRP
              240       250       260       270       280       290
orf5ng-1.pep   IRQTX
               |||||
orf5-1         IRQTX
               300
```

Computer analysis of these amino acid sequences indicates a putative leader sequence, and identified the following homologies:

Homology with Hemolysin Homolog TlyC (Accession U32716) of *H. influenzae*

ORF5 and TlyC proteins show 58% aa identity in 77 aa overlap (BLASTp).

```
ORF5   2   HMAIVIDEYGGTSGLVTFEDIIEQIVGEIEDEFDEDDSADNIHAVSSDTWRIHAATEIED  61
           HMAIV+DE+G  SGLVT EDI+EQIVG+IEDEFDE++ AD I  +S  T+ + A T+I+D
TlyC  166  HMAIVVDEFGAVSGLVTIEDILEQIVGDIEDEFDEEEIAD-IRQLSRHTYAVRALTDIDD 224

ORF5   62  INTFFGTEYSIEEADTI                                            78
           N  F T++  EE DTI
TlyC  225  FNAQFNTDFDDEEVDTI                                           241
```

ORF5ng-1 also shows significant homology with TlyC:

```
                          10        20        30        40        50
orf5ng-1.pep      MDGAQPKTNFFERLIARLAR-EPDSAEDVLNLLRQAHEQEVFDADTLTRLEK
                      ||| :|::| :   |   :  |:::::|::::::::|  :|    :|
tlyc_haein        MNDEQQNSNQSENTKKPFFQSLFGRFFQGELKNREELVEVIRDSEQNDLIDQNTREMIEG
                           10        20        30        40        50        60
                          60        70        80        90       100       109
orf5ng-1.pep      VLDFAELEVRDAMITRSRMNVLKENDSIERITAYVIDTAHSRFPVIGE--DKDEVLGILH
                  :::|||:|||  || ||:: ::::::::   :::|||||||:: |:|:::|||
tlyc_haein        VMEIAELRVRDIMIPRSQIIFIEDQQDLNTCLNTIIESAHSRFPVIADADDRDNIVGILH
                          70        80        90       100       110       120
                  110        120       130       140       150       160
orf5ng-1.pep      AKDLLKYMF-NPEQFHLKSVLRPAVFVPEGKSLTALLKEFREQRNHMAIVIDEYGGTSGL
                  |||||| ::   :|| |||:|||||||||:|:||:|||||||||||||||:||::|||
tlyc_haein        AKDLLKFLREDAEVFDLSSLLRPVVIVPESKRVDRMLKDFRSERFHMAIVVDEFGAVSGL
                          130       140       150       160       170       180
                  170        180       190       200       210       220
orf5ng-1.pep      VTFEDIIEQIVGDIEDEFDEDESADDIHSVSAERWRIHAATEIEDINAFFGTEYGSEEAD
                  |:||||||||||||||||||:|  |:  : :  ||  | :: :||  |: |:  :|| :|
tlyc_haein        VTIEDILEQIVGDIEDEFDEEEIAD-IRQLSRHTYAVRALTDIDDFNAQFNTDFDDEEVD
                          190       200       210       220       230
                  230        240       250       260       270       280
orf5ng-1.pep      TIRRLGHSGIG-TPARARRKSPYRRFAVHRRPRRQPPPAHADGDPREVSRACPTAVSAQF
                  || |   : :|   :  :
tlyc_haein        TIGGLIMQTFGYLPKRGEEIILKNLQFKVTSADSRRLIQLRVTVPDEHLAEMNNVDEKSE
                          240       250       260       270       280       290
```

Homology with a Hypothetical Secreted Protein from *E. coli*:

ORF5a shows homology to a hypothetical secreted protein from *E. coli*:

sp|P77392|YBEX_ECOLI HYPOTHETICAL 33.3 KD PROTEIN IN CUTE-ASNB INTERGENIC
REGION >gi|1778577 (U82598) similar to *H. influenzae* [*Escherichia coli*]
>gi|1786879 (AE000170) f292; This 292 aa ORF is 23% identical (9 gaps) to -continued 272 residues of an approx. 440 aa protein YTFL_HAEIN SW: P44717
[*Escherichia coli*] Length = 292

Score = 212 bits (533), Expect = 3e-54
Identities = 112/230 (48%), Positives = 149/230 (64%), Gaps = 3/230 (1%)

```
Query:    2 DGAQPKTNFXXRLIARLAR-EPDSAEDVLTLLRQAHEQEVFDADTLLRLEKVLDFSDLEV  60
            D   K  F   L+++L     EP + +++L L+R + + ++ D DT    LE V+D +D  V
Sbjct:   10 DTISNKKGFFSLLLSQLFHGEPKNRDELLALIRDSGQNDLIDEDTRDMLEGVMDIADQRV  69

Query:   61 RDAMITRSRMNVLKENDSIERITAYVIDTAHSRFPVIGEDKDEVLGILHAKDLLKYM-FN 119
            RD MI RS+M  LK N +++      +I++AHSRFPVI EDKD + GIL AKDLL +M  +
Sbjct:   70 RDIMIPRSQMITLKRNQTLDECLDVIIESAHSRFPVISEDKDHIEGILMAKDLLPFMRSD 129

Query:  120 PEQFHLKSILRPAVFVPEGKSLTALLKEFREQRNHMAIVIDEYGGTSGLVTFEDIIEQIV 179
              E F +  +LR AV VPE K  +  +LKEFR QR HMAIVIDE+GG SGLVT EDI+E IV
Sbjct:  130 AEAFSMDKVLRQAVVVPESKRVDRMLKEFRSQRYHMAIVIDEFGGVSGLVTIEDILELIV 189

Query:  180 GDIEDEFDEDESADNIHAVSAERWRIHAATEIEDINAFFGTEYSSEEADT           229
            G+IEDE+DE++   D    +S    W + A    IED N  FGT +S EE DT
Sbjct:  190 GEIEDEYDEEDDID-FRQLSRHTWTVRALASIEDFNEAFGTHFSDEEVDT           238
```

Based on this analysis, including the amino acid homology to the TlyC hemolysin-homologue from *H. influenzae* (hemolysins are secreted proteins), it was predicted that the proteins from *N. meningitidis* and *N. gonorrhoeae* are secreted and could thus be useful antigens for vaccines or diagnostics.

ORF5-1 (30.7 kDa) was cloned in the pGex vector and expressed in *E. coli*, as described above. The products of protein expression and purification were analyzed by SDS-PAGE. FIG. 2A shows the results of affinity purification of the GST-fusion protein. Purified GST-fusion protein was used to immunise mice, whose sera were used for Western blot analysis (FIG. 1B). These experiments confirm that ORF5-1 is a surface-exposed protein, and that it is a useful immunogen.

Example 5

The following partial DNA sequence was identified in *N. meningitidis* <SEQ ID 29>:

```
  1 ATGCGCGGCG GCAGGCCGGA TTCCGTTACC GTGCAGATTA TCGAAGGTTC

51 GCGTTTTTCG CATATGAGGA AAGTCATCGA CGCAACGCCC GACATCGGAC

101 ACGACACCAA AGGCTGGAGC AATGAAAAAC TGATGGCGGA AGTTGCGCCC

151 GATGCCTTCA GCGGCAATCC TGAAgGGCAG TTTTTCCCCG ACAGCTACGA

201 AATCGATGCG GGCGGCAGTG ATTTGCAGAT TTACCAAACC GCCTACAAgG

251 GCGATGCAAC GCCGCCTGAA TCAgGGCATG GGAAAGCAGG CAGGACGGGC

301 TGCCTTATAA AAACCCTTAT GAAATGCTGA TTATGGCGAr CCTGGTCGAA

351 AAGGAAACAG GCATGAAGC CGAsCsCGAC CATGTcGCTT CCGTCTTCGT

401 CAACCGCCTG AAAATCGGTA TGCGCCTGCA AACCgAssCG TCCGTGATTT

451 ACGGCATGGG TGCGGCATAC AAGGGCAAAA TCCGTAAAGC CGACCTGCGC

501 CGCGACACGC CGTACAACAC CTACACGCGC GGCGGTCTGC CGCCAACCCC

551 GATTGCGCTG CCC..
```

This corresponds to the amino acid sequence <SEQ ID 30; ORF7>:

```
  1 MRGGRPDSVT VQIIEGSRFS HMRKVIDATP DIGHDTKGWS NEKLMAEVAP

51 DAFSGNPEGQ FFPDSYEIDA GGSDLQIYQT AYKAMQRRLN EAWESRQDGL

101 PYKNPYEMLI MAXLVEKETG HEAXXDHVAS VFVNRLKIGM RLQTXXSVIY

151 GMGAAYKGKI RKADLRRDTP YNTYTRGGLP PTPIALP..
```

Further sequence analysis revealed the complete DNA sequence <SEQ ID 31>:

```
  1 ATGTTGAGAA AATTGTTGAA ATGGTCTGCC GTTTTTTTGA CCGTGTCGGC

51 AGCCGTTTTC GCCGCGCTGC TTTTTGTTCC TAAGGATAAC GGCAGGGCAT

101 ACCGAATCAA AATTGCCAAA AACCAGGGTA TTTCGTCGGT CGGCAGGAAA

151 CTTGCCGAAG ACCGCATCGT GTTCAGCAGG CATGTTTTGA CGGCGGCGGC

201 CTACGTTTTG GGTGTGCACA ACAGGCTGCA TACGGGGACG TACAGATTGC

251 CTTCGGAAGT GTCTGCTTGG GATATCTTGC AGAAAATGCG CGGCGGCAGG

301 CCGGATTCCG TTACCGTGCA GATTATCGAA GGTTCGCGTT TTTCGCATAT

351 GAGGAAAGTC ATCGACGCAA CGCCCGACAT CGGACACGAC ACCAAAGGCT

401 GGAGCAATGA AAAACTGATG GCGGAAGTTG CGCCCGATGC CTTCAGCGGC

451 AATCCTGAAG GGCAGTTTTT CCCCGACAGC TACGAAATCG ATGCGGGCGG

501 CAGTGATTTG CAGATTTACC AAACCGCCTA CAAGGCGATG CAACGCCGCC

551 TGAATGAGGC ATGGGAAAGC AGGCAGGACG GGCTGCCTTA TAAAAACCCT

601 TATGAAATGC TGATTATGGC GAGCCTGGTC GAAAAGGAAA CAGGGCATGA

651 AGCCGACCGC GACCATGTCG CTTCCGTCTT CGTCAACCGC CTGAAAATCG

701 GTATGCGCCT GCAAACCGAC CCGTCCGTGA TTTACGGCAT GGGTGCGGCA

751 TACAAGGGCA AAATCCGTAA AGCCGACCTG CGCCGCGACA CGCCGTACAA

801 CACCTACACG CGCGGCGGTC TGCCGCCAAC CCCGATTGCG CTGCCCGGCA

851 AGGCGGCACT CGATGCCGCC GCCCATCCGT CCGGCGAAAA ATACCTGTAT

901 TTCGTGTCCA AAATGGACGG CACGGGCTTG AGCCAGTTCA GCCATGATTT

951 GACCGAACAC AATGCCGCCG TCCGCAAATA TATTTTGAAA AAATAA
```

This corresponds to the amino acid sequence <SEQ ID 32; ORF7-1>:

```
  1 MLRKLLKWSA VFLTVSAAVF AALLFVPKDN GRAYRIKIAK NQGISSVGRK

51 LAEDRIVFSR HVLTAAAYVL GVHNRLHTGT YRLPSEVSAW DILQKMRGGR

101 PDSVTVQIIE GSRFSHMRKV IDATPDIGHD TKGWSNEKLM AEVAPDAFSG

151 NPEGQFFPDS YEIDAGGSDL QIYQTAYKAM QRRLNEAWES RQDGLPYKNP

201 YEMLIMASLV EKETGHEADR DHVASVFVNR LKIGMRLQTD PSVIYGMGAA

251 YKGKIRKADL RRDTPYNTYT RGGLPPTPIA LPGKAALDAA AHPSGEKYLY

301 FVSKMDGTGL SQFSHDLTEH NAAVRKYILK K*
```

Computer analysis of this amino acid sequence gave the following results:

Homology with Hypothetical Protein Encoded by yceg Gene (Accession P44270) of *H. influenzae*

ORF7 and yceg proteins show 44% aa identity in 192 aa overlap:

```
ORF7    1 MRGGRPDSVTVQIIEGSRFSHMRKVIDATPDIGHDTKGWSNEKLMA-----EVAPDAFSG    55
          + G+      V+ IEG F  RK ++ P +    K SNE++ A         ++ +
yceg  102 LNSGKEVQFNVKWIEGKTFKDWRKDLENAPHLVQTLKDKSNEEIFALLDLPDIGQNLELK   161

ORF7   56 NPEGQFFPDSYEIDAGGSDLQIYQTAYKAMQRRLNEAWESRQDGLPYKNPYEMLIMAXLV   115
          N EG  +PD+Y      +DL++ + + + M++ LN+AW  R + LP  NPYEMLI+A +V
yceg  162 NVEGWLYPDTYNYTPKSTDLELLKRSAERMKKALNKAWNERDEDLPLANPYEMLILASIV   221

ORF7  116 EKETGHEAXXDHVASVFVNRLKIGMRLQTXXSVIYGMGAAYKGKIRKADLRRDTPYNTYT   175
          EKETG       VASVF+NRLK  M+LQT  +VIYGMG  Y G  IRK DL   TPYNTY
yceg  222 EKETGIANERAKVASVFINRLKAKMKLQTDPTVIYGMGENYNGNIRKKDLETKTPYNTYV   281

ORF7  176 RGGLPPTPIALP                                                  187
          GLPPTPIA+P
yceg  282 IDGLPPTPIAMP                                                  293
                                        15
```

The complete length YCEG protein has sequence:

```
  1 MKKFLIAILL LILILAGVAS FSYYKMTEFV KTPVNVQADE LLTIERGTTS

51 SKLATLFEQE KLIADGKLLP YLLKLKPELN KIKAGTYSLE NVKTVQDLLD

101 LLNSGKEVQF NVKWIEGKTF KDWRKDLENA PHLVQTLKDK SNEEIFALLD

151 LPDIGQNLEL KNVEGWLYPD TYNYTPKSTD LELLKRSAER MKKALNKAWN

201 ERDEDLPLAN PYEMLILASI VEKETGIANE RAKVASVFIN RLKAKMKLQT

251 DPTVIYGMGE NYNGNIRKKD LETKTPYNTY VIDGLPPTPI AMPSESSLQA

301 VANPEKTDFY YFVADGSGGH KFTRNLNEHN KAVQEYLRWY RSQKNAK
```

Homology with a Predicted ORF from *N. meningitidis* (Strain A)

ORF7 shows 95.2% identity over a 187aa overlap with an ORF (ORF7a) from strain A of *N. meningitidis*:

```
                                        10        20        30
orf7.pep                              MRGGRPDSVTVQIIEGSRFSHMRKVIDATP
                                      ||||||||||||||||||||||||||||||
orf7a    AAYVLGVHNRLHTGTYRLPSEVSAWDILQMRGGRPDSVTVQIIEGSRFSHMRKVIDATP
                 70        80        90       100       110       120
                40        50        60        70        80        90
orf7.pep  DIGHDTKGWSNEKLMAEVAPDAFSGNPEGQFFPDSYEIDAGGSDLQIYQTAYKAMQRRLN
          ||:|||||||||||||||||||||||||||||||||||||||||||:|||:||||||||||
orf7a     DIEHDTKGWSNEKLMAEVAPDAFSGNPEGQFFPDSYEIDAGGSDLRIYQIAYKAMQRRLN
                130       140       150       160       170       180
                100       110       120       130       140       150
orf7.pep  EAWESRQDGLPYKNPYEMLIMAXLVEKETGHEAXXDHVASVFVNRLKIGMRLQTXXSVIY
          |||||||||||||||||||||:||||||||||:||||||||||||||||||||||:||||
orf7a     EAWESRQDGLPYKNPYEMLIMASLIEKETGHEADRDHVASVFVNRLKIGMRLQTDPSVIY
                190       200       210       220       230       240
                160       170       180
orf7.pep  GMGAAYKGKIRKADLRRDTPYNTYTRGGLPPTPIALP
          |||||||||||||||||||||||||||||||||||||
orf7a     GMGAAYKGKIRKADLRRDTPYNTYTRGGLPPTPIALPGKAALDAAAHPSGEKYLYFVSKM
                250       260       270       280       290       300
orf7a     DGTGLSQFSHDLTEHNAAVRKYILKKX
                310       320       330
```

The complete length ORF7a nucleotide sequence <SEQ ID 33> is:

```
  1 ATGTTGAGAA AATTGTTGAA ATGGTCTGCC GTTTTTTTGA CCGTATCGGC

51 AGCCGTTTTC GCCGCGCTGC TTTTCGTCCC TAAAGACAAC GGCAGGGCAT

101 ACAGGATTAA AATTGCCAAA AACCAGGGTA TTTCGTCGGT CGGCAGGAAA
```

```
                   -continued
151 CTTGCCGAAG ACCGCATCGT GTTCAGCAGG CATGTTTTGA CGGCGGCGGC

201 CTACGTTTTG GGTGTGCACA ACAGGCTGCA TACGGGGACG TACAGACTGC

251 CTTCGGAAGT GTCTGCTTGG GATATCTTGC AGAAAATGCG CGGCGGCAGG

301 CCGGATTCCG TTACCGTGCA GATTATCGAA GGTTCGCGTT TTTCGCATAT

351 GAGGAAAGTC ATCGACGCAA CGCCCGACAT CGAACACGAC ACCAAAGGCT

401 GGAGCAATGA AAAACTGATG GCGGAAGTTG CCCCTGATGC CTTCAGCGGC

451 AATCCTGAAG GCAGTTTTTT CCCCGACAGC TACGAAATCG ATGCGGGCGG

501 CAGCGATTTA CGGATTTACC AAATCGCCTA CAAGGCGATG CAACGCCGAC

551 TGAATGAGGC ATGGGAAAGC AGGCAGGACG GGCTGCCTTA TAAAAACCCT

601 TATGAAATGC TGATTATGGC GAGCCTGATC GAAAAGGAAA CAGGGCATGA

651 AGCCGACCGC GACCATGTCG CTTCCGTCTT CGTCAACCGC CTGAAAATCG

701 GTATGCGCCT GCAAACCGAC CCGTCCGTGA TTTACGGCAT GGGTGCGGCA

751 TACAAGGGCA AAATCCGTAA AGCCGACCTG CGCCGCGACA CGCCGTACAA

801 CACCTACACG CGCGGCGGTC TGCCGCCAAC CCCGATCGCG CTGCCCGGCA

851 AGGCGGCACT CGATGCCGCC GCCCATCCGT CCGGTGAAAA ATACCTGTAT

901 TTCGTGTCCA AAATGGACGG TACGGGCTTG AGCCAGTTCA GCCATGATTT

951 GACCGAACAC AACGCCGCCG TTCGCAAATA TATTTTGAAA AAATAA
```

This is predicted to encode a protein having amino acid sequence <SEQ ID 34>:

```
  1 MLRKLLKWSA VFLTVSAAVF AALLFVPKDN GRAYRIKIAK NQGISSVGRK

51 LAEDRIVFSR HVLTAAAYVL GVHNRLHTGT YRLPSEVSAW DILQKMRGGR

101 PDSVTVQIIE GSRFSHMRKV IDATPDIEHD TKGWSNEKLM AEVAPDAFSG

151 NPEGQFFPDS YEIDAGGSDL RIYQIAYKAM QRRLNEAWES RQDGLPYKNP

201 YEMLIMASLI EKETGHEADR DHVASVFVNR LKIGMRLQTD PSVIYGMGAA

251 YKGKIRKADL RRDTPYNTYT RGGLPPTPIA LPGKAALDAA AHPSGEKYLY

301 FVSKMDGTGL SQFSHDLTEH NAAVRKYILK K*
```

A leader peptide is underlined.
ORF7a and ORF7-1 show 98.8% identity in 331 aa overlap:

```
                    10         20         30         40         50         60
        orf7a.pep   MLRKLLKWSAVFLTVSAAVFAALLFVPKDNGRAYRIKIAKNQGISSVGRKLAEDRIVFSR
                    ||||||||||||||||||||||||||||||||||||||||||||||||||||||||||||
        orf7-1      MLRKLLKWSAVFLTVSAAVFAALLFVPKDNGRAYRIKIAKNQGISSVGRKLAEDRIVFSR
                    10         20         30         40         50         60

70         80         90        100        110        120
        orf7a.pep   HVLTAAAYVLGVHNRLHTGTYRLPSEVSAWDILQKMRGGRPDSVTVQIIEGSRFSHMRKV
                    ||||||||||||||||||||||||||||||||||||||||||||||||||||||||||||
        orf7-1      HVLTAAAYVLGVHNRLHTGTYRLPSEVSAWDILQKMRGGRPDSVTVQIIEGSRFSHMRKV
                    70         80         90        100        110        120

130        140        150        160        170        180
        orf7a.pep   IDATPDIEHDTKGWSNEKLMAEVAPDAFSGNPEGQFFPDSYEIDAGGSDLRIYQIAYKAM
                    ||||||| :|||||||||||||||||||||||||||||||||||||||||| ||||||||
        orf7-1      IDATPDIGHDTKGWSNEKLMAEVAPDAFSGNPEGQFFPDSYEIDAGGSDLQIYQTAYKAM
                    130        140        150        160        170        180
```

```
             190       200       210       220       230       240
orf7a.pep QRRLNEAWESRQDGLPYKNPYEMLIMASLIEKETGHEADRDHVASVFVNRLKIGMRLQTD
          ||||||||||||||||||||||||||||:|||||||||||||||||||||||||||||||
orf7-1    QRRLNEAWESRQDGLPYKNPYEMLIMASLVEKETGHEADRDHVASVFVNRLKIGMRLQTD
             190       200       210       220       230       240
             250       260       270       280       290       300
orf7a.pep PSVIYGMGAAYKGKIRKADLRRDTPYNTYTRGGLPPTPIALPGKAALDAAAHPSGEKYLY
          ||||||||||||||||||||||||||||||||||||||||||||||||||||||||||||
orf7-1    PSVIYGMGAAYKGKIRKADLRRDTPYNTYTRGGLPPTPIALPGKAALDAAAHPSGEKYLY
             250       260       270       280       290       300
             310       320       330
orf7a.pep FVSKMDGTGLSQFSHDLTEHNAAVRKYILKKX
          |||||||||||||||||||||||||||||||
orf7-1    FVSKMDGTGLSQFSHDLTEHNAAVRKYILKKX
             310       320       330
```

Homology with a Predicted ORF from *N. gonorrhoeae*

ORF7 shows 94.7% identity over a 187aa overlap with a predicted ORF (ORF7.ng) from *N. gonorrhoeae*:

```
orf7    MRGGRPDSVTVQIIEGSRFSHMRKVIDATPDIGHDTKGWSNEKLMAEVAPDAFSGNPEGQ   60
        ||||||||||||||||||||||||||||||||||||||||||||||||||||||||||||
orf7ng  MRGGRPDSVTVQIIEGSRFSHMRKVIDATPDIGHDTKGWSNEKLMAEVAPDAFSGNPEGQ   60
orf7    FFPDSYEIDAGGSDLQIYQTAYKAMQRRLNEAWESRQDGLPYKNPYEMLIMAXLVEKETG  120
        ||||||||||||||||||||||||||||||||||||:|||||||||||||||||:||||
orf7ng  FFPDSYEIDAGGSDLQIYQTAYKAMQRRLNEAWAGRQDGLPYKNPYEMLIMASLIEKETG  120
orf7    HEAXXDHVASVFVNRLKIGMRLQTXXSVIYGMGAAYKGKIRKADLRRDTPYNTYTRGGLP  180
        ||| ||||||||||||||||||||  ||||||||||||||||||||||||||||| |||
orf7ng  HEADRDHVASVFVNRLKIGMRLQTDPSVIYGMGAAYKGKIRKADLRRDTPYNTYTGGGLP  180
orf7    PTPIALP                                                      187
        || ||||
orf7ng  PTRIALPGKAAMDAAAHPSGEKYLYFVSKMDGTGLSQFSHDLTEHNAAVRKYILKK     236
```

An ORF7ng nucleotide sequence <SEQ ID 35> is predicted to encode a protein having amino acid sequence <SEQ ID 36>:

```
  1 MRGGRPDSVT VQIIEGSRFS HMRKVIDATP DIGHDTKGWS
    NEKLMAEVAP

51 DAFSGNPEGQ FFPDSYEIDA GGSDLQIYQT AYKAMQRRLN
    EAWAGRQDGL

101 PYKNPYEMLI MASLIEKETG HEADRDHVAS VFVNRLKIGM
    RLQTDPSVIY

151 GMGAAYKGKI RKADLRRDTP YNTYTGGGLP PTRIALPGKA
    AMDAAAHPSG

201 EKYLYFVSKM DGTGLSQFSH DLTEHNAAVR KYILKK*
```

Further sequence analysis revealed a partial DNA sequence of ORF7ng <SEQ ID 37>:

```
  1 . . . taccgaatca AGATTGCCAA AAATCAGGGT
    ATTTCGTCGG TCGGCAGGAA

51 ACTTGCcgaA GACCGCATCG TGTTCAGCAG GCATGTTTTG
    ACAGCGGCGG

101 CCTACGTTTT GGGTGTGCAC AACAGGCTGC ATACGGGGAC
    gTACAGATTG

151 CCTTCGGAAG TGTCTGCTTG GGATATCTTG CAGAAAATGC
    GCGGCGGCAG

201 GCCGGATTCC GTTACCGTGC AGATTATCGA AGGTTCGCGT
    TTTTCGCATA

251 TGAGGAAAGT CATCGACGCA ACGCCCGACA TCGGACACGA
    CACCAAAGGC

301 TGGAGCAATG AAAAACTGAT GGCGGAAGTT GCGCCCGATG
    CCTTCAGCGG

351 CAATCCTGAA GGGCAGTTTT TTCCCGACAG CTACGAAATC
    GATGCGGGCG

401 GCAGCGATTT GCAGATTTAC CAAACCGCCT ACAAGGCGAT
    GCAACGCCGC

451 CTGAACGAGG CATGGGCAGG CAGGCAGGAC GGGCTGCCTT
    ATAAAAACCC

501 TTATGAAATG CTGATTATGG CGAGCCTGAT CGAAAAGGAA
    ACGGGGCATG

551 AGGCCGACCG CGACCATGTC GCTTCCGTCT TCGTCAACCG
    CCTGAAAATC

601 GGTATGCGCC TGCAAACCGA CCCGTCCGTG ATTTACGGCA
    TGGGTGCGGC

651 ATACAAGGGC AAAATCCGTA AAGCCGACCT GCGCCGCGAC
    ACGCCGTACA 701 aCAccTAtac gggcgggggc ttgccgccaa cccggattgc
    gctgcccggC 751 Aaggcggcaa tggatgccgc cgcccacccg tccggcgaAa
    aatacctgTa 801 tttcgtgtcC AAAATGGACG GCACGGGCTT GAGCCAGTTC
    AGCCATGATT 851 TGACCGAACA CAACGCCGCc gTcCGCAAAT ATATTTTGAA
    AAAATAA
```

This corresponds to the amino acid sequence <SEQ ID 38; ORF7ng-1>:

```
  1 .... YRIKIAKNQG ISSVGRKLAE DRIVFSRHVL
       TAAAYVLGVH NRLHTGTYRL

51 PSEVSAWDIL QKMRGGRPDS VTVQIIEGSR FSHMRKVIDA
       TPDIGHDTKG

101 WSNEKLMAEV APDAFSGNPE GQFFPDSYEI DAGGSDLQIY
       QTAYKAMQRR
```

-continued
```
151 LNEAWAGRQD GLPYKNPYEM LIMASLIEKE TGHEADRDHV
       ASVFVNRLKI

201 GMRLQTDPSV IYGMGAAYKG KIRKADLRRD TPYNTYTGGG
       LPPTRIALPG

251 KAAMDAAAHP SGEKYLYFVS KMDGTGLSQF SHDLTEHNAA
       VRKYILKK*
```

ORF7ng-1 and ORF7-1 show 98.0% identity in 298 aa overlap:

```
                   10         20         30         40         50         60
orf7-1.pep  KLLKWSAVFLTVSAAVFAALLFVPKDNGRAYRIKIAKNQGISSVGRKLAEDRIVFSRHVL
                                         ||||||||||||||||||||||||||||||
orf7ng-1                                 YRIKIAKNQGISSVGRKLAEDRIVFSRHVL
                                                  10        20        30

70         80         90        100        110        120
orf7-1.pep  TAAAYVLGVHNRLHTGTYRLPSEVSAWDILQKMRGGRPDSVTVQIIEGSRFSHMRKVIDA
            ||||||||||||||||||||||||||||||||||||||||||||||||||||||||||||
orf7ng-1    TAAAYVLGVHNRLHTGTYRLPSEVSAWDILQKMRGGRPDSVTVQIIEGSRFSHMRKVIDA
                  40        50        60        70        80        90

130        140        150        160        170        180
orf7-1.pep  TPDIGHDTKGWSNEKLMAEVAPDAFSGNPEGQFFPDSYEIDAGGSDLQIYQTAYKAMQRR
            ||||||||||||||||||||||||||||||||||||||||||||||||||||||||||||
orf7ng-1    TPDIGHDTKGWSNEKLMAEVAPDAFSGNPEGQFFPDSYEIDAGGSDLQIYQTAYKAMQRR
                 100       110       120       130       140       150

190        200        210        220        230        240
orf7-1.pep  LNEAWESRQDGLPYKNPYEMLIMASLVEKETGHEADRDHVASVFVNRLKIGMRLQTDPSV
            ||||  :|||||||||||||||||||| :|||||||||||||||||||||||||||||||
orf7ng-1    LNEAWAGRQDGLPYKNPYEMLIMASLIEKETGHEADRDHVASVFVNRLKIGMRLQTDPSV
                 160       170       180       190       200       210

250        260        270        280        290        300
orf7-1.pep  IYGMGAAYKGKIRKADLRRDTPYNTYTRGGLPPTPIALPGKAALDAAAHPSGEKYLYFVS
            ||||||||||||||||||||||||||||  |||||| |||||||  ||||||||||||||
orf7ng-1    IYGMGAAYKGKIRKADLRRDTPYNTYTGGGLPPTRIALPGKAAMDAAAHPSGEKYLYFVS
                 220       230       240       250       260       270

310        320        330
orf7-1.pep  KMDGTGLSQFSHDLTEHNAAVRKYILKKX
            ||||||||||||||||||||||||||||
orf7ng-1    KMDGTGLSQFSHDLTEHNAAVRKYILKKX
                 280       290
```

In addition, ORF7ng-1 shows significant homology with a hypothetical *E. coli* protein:

```
sp|P28306|YCEG_ECOLI HYPOTHETICAL 38.2 KD PROTEIN IN PABC-HOLB INTERGENIC
REGION gi|1787339 (AE000210) o340; 100% identical to fragment YCEG_ECOLI
SW: P28306 but has 97 additional C-terminal residues [Escherichia coli]
Length = 340  Score = 79 (36.2 bits), Expect = 5.0e-57, Sum P(2) = 5.0e-57
Identities = 20/87 (22%), Positives = 40/87 (45%)
Query:   10 GISSVGRKLAEDRIVFSRHVLTAAAYVLGVHNRLHTGTYRLPSEVSAWDILQKMRGGRPD   69
            G  ++G +L  D+I+     V      +     GTYR   +++  ++L+ +    G+
Sbjct:   49 GRLALGEQLYADKIINRPRVFQWLLRIEPDLSHFKAGTYRFTPQMTVREMLKLLESGKEA  108

Query:   70 SVTVQIIEGSRFSHMRKVIDATPDIGH                                  96
            ++++EG  R  S    K +    P I H
Sbjct:  109 QFPLRLVEGMRLSDYLKQLREAPYIKH                                  135

Score = 438 (200.7 bits), Expect = 5.0e-57, Sum P(2) = 5.0e-57
Identities = 84/155 (54%), Positives = 111/155 (71%)
Query:  120 EGQFFPDSYEIDAGGSDLQIYQTAYKAMQRRLNEAWAGRQDGLPYKNPYEMLIMASLIEK  179
            EG F+PD++    A  +D+ + + A+K M + ++ AW GR DGLPYK+ +++ MAS+IEK
Sbjct:  158 EGWFWPDTWMYTANTTDVALLKRAHKKNVKAVDSAWEGRADGLPYKDKNQLVTMASIIEK  217

Query:  180 ETGHEADRDHVASVFVNRLKIGMRLQTDPSVIYGMGAAYKGKIRKADLRRDTPYNTYTGG  239
            ET    ++RD VASVF+NRL+IGMRLQTDP +VIYGMG  Y GK+ +ADL   T YNTYT
Sbjct:  218 ETAVASERDKVASVFINRIGMRLQTDPTVIYGHGERYNGKLSRADLETPTAYNTYTIT   277

Query:  240 GLPPTRIALPGKAAMDAAAHPSGEKYLYFVSKMDG                          274
            GLPP  IA PG ++ AAAHP+   YLYF+    G
Sbjct:  278 GLPPGAIATPGADSLKAAAHPAKTPYLYFVADGKG                          312
```

Based on this analysis, including the fact that the *H. influenzae* YCEG protein possesses a possible leader sequence, it is predicted that the proteins from *N. meningitidis* and *N. gonorrhoeae*, and their epitopes, could be useful antigens for vaccines or diagnostics, or for raising antibodies.

Example 6

The following partial DNA sequence was identified in *N. meningitidis* <SEQ ID 39>:

```
  1 CGTTTCAAAA TGTTAACTGT GTTGACGGCA ACCTTGATTG
    CCGGACAGGT

51 ATCTGCCGCC GGAGGCGGTG CGGGGGATAT GAAACAGCCG
    AAGGAAGTCG

101 GAAAGGTTTT CAGAAAGCAG CAGCGTTACA GCGAGGAAGA
    AATCAAAAAC

151 GAACGCGCAC GGCTTGCGGC AGTGGGCGAG CGGGTTAATC
    AGATATTTAC

201 GTTGCTGGGA GGGGAAACCG CCTTGCAAAA GGGGCAGGCG
    GGAACGGCTC

251 TGGCAACCTA TATGCTGATG TTGGAACGCA CAAAATCCCC
    CGAAGTCGCC

301 GAACGCGCCT TGGAAATGGC CGTGTCGCTG AACGCGTTTG
    AACAGGCGGA

351 AATGATTTAT CAGAAATGGC GGCAGATTGA GCCTATACCG
    GGTAAGGCGC

401 AAAAACGGGC GGGGTGGCTG CGGAACGTGC TGAGGGAAAG
    AGGAAATCAG

451 CATCTGGACG GACGGGAAGA AGTGCTGGCT CAGGCGGACG
    AAGGACAG
```

This corresponds to the amino acid sequence <SEQ ID 40; ORF9>:

```
  1 . . . RFKMLTVLTA TLIAGQVSAA GGGAGDMKQP
    KEVGKVFRKQ QRYSEEEIKN

51 ERARLAAVGE RVNQIFTLLG GETALQKGQA GTALATYMLM
    LERTKSPEVA

101 ERALEMAVSL NAFEQAEMIY QKWRQIEPIP GKAQKRAGWL
    RNVLRERGNQ

151 HLDGREEVLA QADEGQ
```

Further sequence analysis revealed the complete DNA sequence <SEQ ID 41>:

```
   1 ATGTTACCTA ACCGTTTCAA AATGTTAACT GTGTTGACGG
     CAACCTTGAT

51 TGCCGGACAG GTATCTGCCG CCGGAGGCGG TGCGGGGGAT
     ATGAAACAGC

101 CGAAGGAAGT CGGAAAGGTT TTCAGAAAGC AGCAGCGTTA
     CAGCGAGGAA

151 GAAATCAAAA ACGAACGCGC ACGGCTTGCG GCAGTGGGCG
     AGCGGGTTAA

201 TCAGATATTT ACGTTGCTGG GAGGGGAAAC CGCCTTGCAA
     AAGGGGCAGG

251 CGGGAACGGC TCTGGCAACC TATATGCTGA TGTTGGAACG
     CACAAAATCC

301 CCCGAAGTCG CCGAACGCGC CTTGGAAATG GCCGTGTCGC
     TGAACGCGTT

351 TGAACAGGCG GAAATGATTT ATCAGAAATG GCGGCAGATT
     GAGCCTATAC

401 CGGGTAAGGC GCAAAAACGG GCGGGGTGGC TGCGGAACGT
     GCTGAGGGAA

451 AGAGGAAATC AGCATCTGGA CGGACTGGAA GAAGTGCTGG
     CTCAGGCGGA

501 CGAAGGACAG AACCGCAGGG TGTTTTTATT GTTGGCACAA
     GCCGCCGTGC

551 AACAGGACGG GTTGGCGCAA AAAGCATCGA AAGCGGTTCG
     CCGCGCGGCG

601 TTGAAATATG AACATCTGCC CGAAGCGGCG GTTGCCGATG
     TGGTGTTCAG

651 CGTACAGGGA CGCGAAAAGG AAAAGGCAAT CGGAGCTTTG
     CAGCGTTTGG

701 CGAAGCTCGA TACGGAAATA TTGCCCCCCA CTTTAATGAC
     GTTGCGTCTG

751 ACTGCACGCA AATATCCCGA AATACTCGAC GGCTTTTTCG
     AGCAGACAGA

801 CACCCAAAAC CTTTCGCCCG TCTGGCAGGA AATGGAAATT
     ATGAATCTGG

851 TTTCCCTGCA CAGGCTGGAT GATGCCTATG CGCGTTTGAA
     CGTGCTGTTG

901 GAACGCAATC CGAATGCAGA CCTGTATATT CAGGCAGCGA
     TATTGGCGGC

951 AAACCGAAAA GAAGGTGCTT CCGTTATCGA CGGCTACGCC
     GAAAAGGCAT

1001 ACGGCAGGGG GACGGAGGAA CAGCGGAGCA GGGCGGCGCT
     AACGGCGGCG

1051 ATGATGTATG CCGACCGCAG GGATTACGCC AAAGTCAGGC
     AGTGGCTGAA

1101 AAAAGTATCC GCGCCGGAAT ACCTGTTCGA CAAAGGTGTG
     CTCGCGGCTG

1151 CGGCGGCTGT CGAGTTGGAC GGCGGCAGGG CGGCTTTGCG
     GCAGATCGGC

1201 AGGGTGCGGA AACTTCCCGA ACAGCAGGGG CGGTATTTTA
     CGGCAGACAA

1251 TTTGTCCAAA ATACAGATGC TCGCCCTGTC GAAGCTGCCC
     GATAAACGGG

1301 AGGCTTTGAG GGGGTTGGAC AAGATTATCG AAAAACCGCC
     TGCCGGCAGT

1351 AATACAGAGT TACAGGCAGA GGCATTGGTA CAGCGGTCAG
     TTGTTTACGA

1401 TCGGCTTGGC AAGCGGAAAA AAATGATTTC AGATCTTGAA
     AGGGCGTTCA

1451 GGCTTGCACC CGATAACGCT CAGATTATGA ATAATCTGGG
     CTACAGCCTG
```

```
1501 CTGACCGATT CCAAACGTTT GGACGAAGGT TTCGCCCTGC
     TTCAGACGGC
1551 ATACCAAATC AACCCGGACG ATACCGCTGT CAACGACAGC
     ATAGGCTGGG
1601 CGTATTACCT GAAAGGCGAC GCGGAAAGCG CGCTGCCGTA
     TCTGCGGTAT
1651 TCGTTTGAAA ACGACCCCGA GCCCGAAGTT GCCGCCCATT
     TGGGCGAAGT
1701 GTTGTGGGCA TTGGGCGAAC GCGATCAGGC GGTTGACGTA
     TGGACGCAGG
1751 CGGCACACCT TACGGGAGAC AAGAAAATAT GGCGGGAAAC
     GCTCAAACGT
1801 CACGGCATCG CATTGCCCCA ACCTTCCCGA AACCTCGGA
     AATAA
```

This corresponds to the amino acid sequence <SEQ ID 42; ORF9-1>:

```
  1 MLPNRFKMLT VLTATLIAGQ VSAAGGGAGD MKQPKEVGKV
    FRKQQRYSEE
 51 EIKNERARLA AVGERVNQIF TLLGGETALQ KGQAGTALAT
    YMLMLERTKS
101 PEVAERALEM AVSLNAFEQA EMIYQKWRQI EPIPGKAQKR
    AGWLRNVLRE
151 RGNQHLDGLE EVLAQADEGQ NRRVFLLLAQ AAVQQDGLAQ
    KASKAVRRAA
201 LKYEHLPEAA VADVVFSVQG REKEKAIGAL QRLAKLDTEI
    LPPTLMTLRL
251 TARKYPEILD GFFEQTDTQN LSAVWQEMEI MNLVSLHRLD
    DAYARLNVLL
301 ERNPNADLYI QAAILAANRK EGASVIDGYA EKAYGRGTEE
    QRSRAALTAA
351 MMYADRRDYA KVRQWLKKVS APEYLFDKGV LAAAAAVELD
    GGRAALRQIG
401 RVRKLPEQQG RYFTADNLSK IQMLALSKLP DKREALRGLD
    KIIEKPPAGS
451 NTELQAEALV QRSVVYDRLG KRKKMISDLE PAFRLAPDNA
    QIMNNLGYSL
501 LTDSKRLDEG FALLQTAYQI NPDDTAVNDS IGWAYYLKGD
    AESALPYLRY
551 SFENDPEPEV AAHLGEVLWA LGERDQAVDV WTQAAHLTGD
    KKIWRETLKR
601 HGIALPQPSR KPRK*
```

Computer analysis of this amino acid sequence gave the following results:

Homology with a Predicted ORF from *N. meningitidis* (Strain A)

ORF9 shows 89.8% identity over a 166aa overlap with an ORF (ORF9a) from strain A of *N. meningitidis*.

```
                          10        20        30        40        50
orf9.pep        RFKMLTVLTATLIAGQVSAAGGGAGDMKQPKEVGKVFRKQQRYSEEEIKNERARLA
                || :|:||:|:|:|||: ||  ||:| | ||||||||||||||||||||||||||
orf9a       MLPARFTILSVLAAALLAGQAYAA--GAADAKPPKEVGKVFRKQQRYSEEEIKNERARLA
                    10        20          30        40        50

60        70        80        90       100       110
orf9.pep    AVGERVNQIFTLLGGETALQKGQAGTALATYMLMLERTKSPEVAERALEMAVSLNAFEQA
            |||||||||||||| |||||||||||||||||||||||||||||||||||||||||||||
orf9a       AVGERVNQIFTLLGXETALQKGQAGTALATYMLMLERTKSPEVAERALEMAVSLNAFEQA
            60        70        80        90       100       110

120       130       140       150       160
orf9.pep    EMIYQKWRQIEPIPGKAQKRAGWLRNVLRERGNQHLDGREEVLAQADEGQ
            |||||||||||||||||||||||||||||||||||||| || |||||| |
orf9a       EMIYQKWRQIEPIPGKAQKRAGWLRNVLRERGNQHLDGLEEXLAQADEXQNRRVFLLLAQ
           120       130       140       150       160       170 orf9a       AAVQQDGLAQKASKAVRRAALRYEHLPEAAVADVVFSVQXREKEKAIGALQRLAKLDTEI
           180       190       200       210       220       230
```

The complete length ORF9a nucleotide sequence <SEQ ID 43> is:

```
   1 ATGTTACCCG CCCGTTTCAC CATTTTATCT GTGCTCGCGG
     CAGCCCTGCT
  51 TGCCGGGCAG GCGTATGCCG CCGGCGCGGC GGATGCGAAG
     CCGCCGAAGG
 101 AAGTCGGAAA GGTTTTCAGA AAGCAGCAGC GTTACAGCGA
     GGAAGAAATC
 151 AAAAACGAAC GCGCACGGCT TGCGGCAGTG GGCGAGCGGG
     TTAATCAGAT
 201 ATTTACGTTG CTGGGANGGG AAACCGCCTT GCAAAAGGGG
     CAGGCGGGAA
 251 CGGCTCTGGC AACCTATATG CTGATGTTGG AACGCACAAA
     ATCCCCCGAA
 301 GTCGCCGAAC GCGCCTTGCA AATGGCCGTG TCNCTGAACG
     CGTTTGAACA
 351 GGCGGAAATG ATTTATCAGA AATGGCGGCA GATTGAGCCT
     ATACCGGGTA
 401 AGGCGCAAAA ACGGGCGGGG TGGCTGCGGA ACGTGCTGAG
     GCAAAGAGGA
 451 AATCAGCATC TAGACGGACT GGAAGAANTG CTGGCTCAGG
     CGGACGAANG
 501 ACAGAACCGC AGGGTGTTTT TATTGTTGGC ACAAGCCGCC
     GTGCAACAGG
 551 ACGGGTTGGC GCAAAAAGCA TCGAAAGCGG TTCGCCGCGC
     GGCGTTGAGA
 601 TATGAACATC TCCCCGAAGC GGCGGTTGCC GATGTGGTGT
     TCAGCGTACA
 651 GGNACGCGAA AAGGAAAAGG CAATCGGAGC TTTGCAGCGT
     TTGGCGAAGC
 701 TCGATACGGA AATATTGCCC CCCACTTTAA TGACGTTGCG
     TCTGACTGCA
 751 CGCAAATATC CCGAAATACT CGACGGCTTT TTCGAGCAGA
     CAGACACCCA
 801 AAACCTTTCG GCCGTCTGGC AGGAAATGGA AATTATGAAT
     CTGGTTTCCC
 851 TGCACAGGCT GGATGATGCC TATGCGCGTT TGAACGTGCT
     GTTGGAACGC
 901 AATCCGAATG CAGACCTGTA TATTCAGGCA GCGATATTGG
     CGGCAAACCG
 951 AAAAGAANGT GCTTCCGTTA TCGACGGCTA CGCCGAAAAG
     GCATACGGCA
1001 GGGGGACGGG GGAACAGCGG GGCAGGGCGG CAATGACGGC
     GGCGATGATA
1051 TATGCCGACC GAAGGGATTA CACCAAAGTC AGGCAGTGGT
     TGAAAAAAGT
1101 GTCCGCGCCG GAATACCTGT TCGACAAAGG TGTGCTGGCG
     GCTGCGGCGG
1151 CTGTCGAGTT GGACNGCGGC AGGGCGGCTT GCGGCAGAT
     CGGCAGCGTG
1201 CGGAAACTTC CCGAACAGCA GGGGCGGTAT TTTACGGCAG
     ACAATTTGTC
1251 CAAAATACAG ATGTTCGCCC TGTCGAAGCT GCCCGACAAA
     CGGGAGGCTT
1301 TGAGGGGGTT GGACAAGATT ATCGAAAAAC CGCCTGCCGG
     CAGTAATACA
1351 GAGTTACAGG CAGAGGCATT GGTACAGCCG TCAGTTGTTT
     ACGATCGGCT
1401 TGGCAAGCGG AAAAAAATGA TTTCAGATCT TGAAAGGGCG
     TTCAGGCTTG
1451 CACCCGATAA CGCTCAGATT ATGAATAATC TGGGCTACAG
     CCTGCTTTCC
1501 GATTCCAAAC GTTTGGACGA AGGCTTCGCC CTGCTTCAGA
     CGGCATACCA
1551 AATCAACCCG GACGATACCG CTGTCAACGA CAGCATAGGC
     TGGGCGTATT
1601 ACCTGAAANG CGACGCGGAA AGCGCGCTGC CGTATCTGCG
     GTATTCGTTT
1651 GAAAACGACC CCGAGCCCGA AGTTGCCGCC CATTTGGGCG
     AAGTGTTGTG
1701 GGCATTGGGC GAACGCGATC AGGCGGTTGA CGTATGGACG
     CAGGCGGCAC
1751 ACCTTACGGG AGACAAGAAA ATATGGCGGG AAACGCTCAA
     ACGTCACGGC
1801 ATCGCATTGC CCCAACCTTC CCGAAAACCT CGGAAATAA
```

This encodes a protein having amino acid sequence <SEQ ID 44>:

```
  1 MLPARFTILS VLAAALLAGQ AYAAGAADAK PPKEVGKVFR
    KQQRYSEEEI
 51 KNERARLAAV GERVNQIFTL LGXETALQKG QAGTALATYM
    LMLERTKSPE
101 VAERALEMAV SLNAFEQAEM IYQKWRQIEP IPGKAQKRAG
    WLRNVLRERG
151 NQHLDGLEEX LAQADEXQNR RVFLLLAQAA VQQDGLAQKA
    SKAVRRAALR
201 YEHLPEAAVA DVVFSVQXRE KEKAIGALQR LAKLDTEILP
    PTLMTLRLTA
251 RKYPEILDGF FEQTDTQNLS AVWQEMEIMN LVSLHRLDDA
    YARLNVLLER
301 NPNADLYIQA AILAANRKEX ASVIDGYAEK AYGRGTGEQR
    GRAAMTAAMI
351 YADRRDYTKV RQWLKKVSAP EYLFDKGVLA AAAAVELDXG
    RAALRQIGRV
401 RKLPEQQGRY FTADNLSKIQ MFALSKLPDK REALRGLDKI
    IEKPPAGSNT
451 ELQAEALVQR SVVYDRLGKR KKMISDLERA FRLAPDNAQI
    MNNLGYSLLS
501 DSKRLDEGFA LLQTAYQINP DDTAVNDSIG WAYYLKXDAE
    SALPYLRYSF
551 ENDPEFEVAA HLGEVLWALG ERDQAVDVWT QAAHLTGDKK
    IWRETLKRHG
601 IALPQPSRKP RK*
```

ORF9a and ORF9-1 show 95.3% identity in 614 aa overlap:

```
          10        20        30        40        50
orf9a.pep MLPARFTILSVLAAALLAGQAYAAG--AADAKPPKEVGKVFRKQQRYSEEEIKNERARLA
          |||  ||  : | :|:|:|||  :  ||| : | ||||||||||||||||||||||||||
orf9-1    MLPNRFKMLTVLTATLIAGQVSAAGGGAGDMKQPKEVGKVFRKQQRYSEEEIKNERARLA
           10        20        30        40        50        60
           60        70        80        90       100       110
orf9a.pep AVGERVNQIFTLLGXETALQKGQAGTALATYMLMLERTKSPEVAERALEMAVSLNAFEQA
          ||||||||||||||| ||||||||||||||||||||||||||||||||||||||||||||
orf9-1    AVGERVNQIFTLLGGETALQKGQAGTALATYMLMLERTKSPEVAERALEMAVSLNAFEQA
            70        80        90       100       110       120
          120       130       140       150       160       170
orf9a.pep EMIYQKWRQIEPIPGKAQKRAGWLRNVLRERGNQHLDGLEEXLAQADEXQNRRVFLLLAQ
          |||||||||||||||||||||||||||||||||||||||| ||||||| |||||||||||
orf9-1    EMIYQKWRQIEPIPGKAQKRAGWLRNVLRERGNQHLDGLEEVLAQADEGNRRVFLLLAQ
           130       140       150       160       170       180
          180       190       200       210       220       230
orf9a.pep AAVQQDGLAQKASKAVRRAALRYEHLPEAAVADVVFSVQXREKEKAIGALQRLAKLDTEI
          ||||||||||||||||||||| :|||||||||||||||| ||||||||||||||||||||
orf9-1    AAVQQDGLAQKASKAVRRAALKYEHLPEAAVADVVFSVQGREKEKAIGALQRLAKLDTEI
           190       200       210       220       230       240
          240       250       260       270       280       290
orf9a.pep LPPTLMTLRLTARKYPEILDGFFEQTDTQNLSAVWQEMEIMNLVSLHRLDDDAYARLNVLL
          ||||||||||||||||||||||||||||||||||||||||||||||||||||||||||||
orf9-1    LPPTLMTLRLTARKYPEILDGFFEQTDTQNLSAVWQEMEIMNLVSLHRLDDDAYARLNVLL
           250       260       270       280       290       300
          300       310       320       330       340       350
orf9a.pep ERNPNADLYIQAAILAANRKEXASVIDGYAEKAYGRGTGEQRGRAAMTAAMIYADRRDYT
          ||||||||||||||||||||| |||||||||||||||| ||: ||||:||||||||||:
orf9-1    ERNPNADLYIQAAILAANRKEGASVIDGYAEKAYGRGTEEQRSAALTAAMMYADRRDYA
           310       320       330       340       350       360
          360       370       380       390       400       410
orf9a.pep KVRQWLKKVSAPEYLFDKGVLAAAAAVELDXGRAALRQIGRVRKLPEQQGRYFTADNLSK
          |||||||||||||||||||||||||||||| |||||||||||||||||||||||||||||
orf9-1    KVRQWLKKVSAPEYLFDKGVLAAAAAVELDGGRAALRQIGRVRKLPEQQGRYFTADNLSK
           370       380       390       400       410       420
          420       430       440       450       460       470
orf9a.pep IQMFALSKLPDKREALRGLDKIIEKPPAGSNTELQAEALVQRSVVYDRLGKRKKMISDLE
          |||:||||||||||||||||||||||||||||||||||||||||||||||||||||||||
orf9-1    IQMLALSKLPDKREALRGLDKIIEKPPAGSNTELQAEALVQRSVVYDRLGKRKKMISDLE
           430       440       450       460       470       480
          480       490       500       510       520       530
orf9a.pep RAFRLAPDNAQIMNNLGYSLLSDSKRLDEGFALLQTAYQINPDDTAVNDSIGWAYYLKXD
          |||||||||||||||||||||| :|||||||||||||||||||||||||||||||||| |
orf9-1    RAFRLAPDNAQIMNNLGYSLLTDSKRLDEGFALLQTAYQINPDDTAVNDSIGWAYYLKGD
           490       500       510       520       530       540
          540       550       560       570       580       590
orf9a.pep AESALPYLRYSFENDPEPEVAAHLGEVLWALGERDQAVDVWTQAAHLTGDKKIWRETLKR
          ||||||||||||||||||||||||||||||||||||||||||||||||||||||||||||
orf9-1    AESALPYLRYSFENDPEPEVAAHLGEVLWALGERDQAVDVWTQAAHLTGDKKIWRETLKR
           550       560       570       580       590       600
          600       610
orf9a.pep HGIALPQPSRKPRKX
          |||||||||||||||
orf9-1    HGIALPQPSRKPRKX
           610
```

Homology with a Predicted ORF from *N. gonorrhoeae*

ORF9 shows 82.8% identity over a 163aa overlap with a predicted ORF (ORF9.ng) from *N. gonorrhoeae*.

```
Orf9    RFKMLTVLTATLIAGQVSAAGGGAGDMKQPKEVGKVFRKQQRYSEEEIKNERAR    54
        ||  :| :| | | :||| :  ||   ||:| : |||||||:| ::|||||||||
orf9ng  MIMLPARFTILSVLAAALLAGQAYAA--GAADVELPKEVGKVLRKHRRYSEEEIKNERAR  58

Orf9    LAAVGERVNQIFTLLGGETALQKGQAGTALATYMLMLERTKSPEVAERALEMAVSLNAFE  114
        ||||||||| :||||||||||||||||||||||||||||||||||||||||||||||||
orf9ng  LAAVGERVNRVFTLLGGETALQKGQAGTALATYMLMLERTKSPEVAERALEMAVSLNAFE  118

Orf9    QAEMIYQKWRQIEPIPGKAQKRAGWLRNVLRERGNQHLDGREEVLAQADEGQ          166
        ||||||||||||||||| ||| ||||||||| ||| ||| |||  ||:|
orf9ng  QAEMIYQKWRQIEPIPGEAQKPAGWLRNVLKEGGNPHLDRLEEVPAQSDYVHQPMIFLLL  178
```

The ORF9ng nucleotide sequence <SEQ ID 45> was predicted to encode a protein having including acid sequence <SEQ ID 46>:

```
  1 MIMLPARFTI LSVLAAALLA GQAYAAGAAD VELPKEVGKV
    LRKHRRYSEE

51 EIKNERARLA AVGERVNRVF TLLGGETALQ KGQAGTALAT
    YMLMLERTKS

101 PEVAERALEM AVSLNAFEQA EMIYQKWRQI EPIPGEAQKP
    AGWLRNVLKE

151 GGNPHLDRLE EVPAQSDYVH QPMIFLLLVQ AAVQHGGVAQ
    KPSKAVRPAA

201 YNYEVLPETA GADAVFCVQG PQYEKAIQSF PPCGRNPQTE
    NIAPPFNELF

251 RPTARPISPK LLQRFFRTEP NLAKPFRPPG PEMETYQTGF
    PRPLTRNNPT
```

Amino acids 1-28 are a putative leader sequence, and 173-189 are predicted to be a transmembrane domain.

Further sequence analysis revealed the complete length ORF9ng DNA sequence <SEQ ID 47>:

```
   1 ATGTTACCCG CCCGTTTCAC TATTTTATCT GTCCTCGCAG
     CAGCCCTGCT

51 TGCCGGACAG GCGTATGCTG CCGGCGCGGC GGATGTGGAG
     CTGCCCAAGG

101 AAGTCGGAAA GGTTTTAAGG AAACATCGGC GTTACAGCGA
     GGAAGAAATC

151 AAAAACGAAC GCGCACGGCT TGCGGCAGTG GGCGAACGGG
     TCAACAGGGT

201 GTTTACGCTG TTGGGCGCTG AAACGGCTTT GCAGAAGGGG
     CAGGCGGGAA

251 CGGCTCTGGC AACCTATATG CTGATGTTGG AACGCACAAA
     ATCCCCCGAA

301 GTCGCCGAAC GCGCCTTGGA AATGGCCGTG TCGCTGAACG
     CGTTTGAACA

351 GGCGGAAATG ATTTATCAGA AATGgcggca gatcgagcct
     ataCcgggtg 401 aggcgcaaaa accgGcgggG tggctgcgga acgtattgaa
     ggaagggGGa 451 aaTCAGCATC TGGAcgggtt gaaagaggTG CtggcgcaAT
     cggacgatGT 501 GCAAAAAcgc aggaTATTTT TGCTGCTGGT GCAAGCCGCC
     GTGCagcagg 551 gTGGGGTGGC TCAAAAAGCA TCGAAAGCGG TTCGCcgtgc
     GGcgttgaAG 601 TATGAACATC TGCCcgaagc ggcggTTGCC GATGCggTGT
     TCGGCGTACA 651 GGGACGCGAA AAGGAAAagg caaTCGAAGC TTTGCAGCGT
     TTGGCGAAGC

701 TCGATACGGA AATATTGCCC CCACTTTAA TGACGTTGCG
     TCTGACTGCA

751 CGCAAATATC CGAAATACT CGACGGCTTT TTCGAGCAGA
     CAGACACCCA

801 AAACCTTTCG GCCGTCTGGC AGGAAATGGA AATTATGAAT
     CTGGTTTCCC

851 TGCGTAAGCC GGATGATGCC TATGCGCGTT TGAACGTGCT
     GTTGGAACAC

901 AACCCGAATG CAAACCTGTA TATTCAGGCG GCGATATTGG
     CGGCAAACCG

951 AAAAGAAGGT GCGTCCGTTA TCGACGGCTA CGCCGAAAAG
     GCATACGGCA

1001 GGGGGACGGG GGAACAGCGG GGCagggcgg cAATgacggc
     GGCGATGATA

1051 TATCCCGACC GCAGGGATTA CGCCAAAGTC AGGCAGTGGT
     TGAAAAAAGT

1101 GTCCGCGCCG GAATACCTGT TCGACAAAGG CGTGCTGGCG
     GCTGCGGCGG

1151 CTGCCGAATT GGACGGAGGC CGGGCGGCTT TGCGGCAGAT
     CGGCAGCGTG

1201 CGGAAACTTC CCGAACAGCA GGGGCGGTAT TTTACGGCAG
     ACAATTTGTC

1251 CAAAATACAG ATGCTCGCCC TGTCGAAGCT GCCCGACAAA
     CGGGAAGCCC

1301 TGATCCCGCT GAACAACATC ATCGCCAAAC TTTCGGCGGC
     GGGAAGCACG

1351 GAACCTTTGG CGGAAGCATT GGCACAGCGT TCCATTATTT
     ACGaacAGTT 1401 cggCAAACGG GGAAAAATGA TTGCCGACCT tgaAACcgcg
     CTCAAACTTA

1451 CGCCCGATAA TGCACAAATT ATGAATAATC TGGGCTACAG
     CCTGCTTTCC

1501 GATTCCAAAC GTTTGGACGA GGGTTTCGCC CTGCTTCAGA
     CGGCATACCA

1551 AATCAACCCG GACGATACCG CCGTTAACGA CAGCATAGGC
     TGGGCGTATT

1601 ACCTGAAAGG CGACgcggaA AGCGCGCTGC CGTATCTGcg
     gtattcgttt 1651 gAAAACGACC CCCAGCCCGA AGTTGCCGCC CATTTGGGCG
     AAGTGTTGTG

1701 GGCATTGCGC GAACGCGATC AGGCGGTTGA CGTATGGACG
     CAGGCGGCAC

1751 ACCTTAGCGG AGACAAGAAA ATATGGCGGG AGACGCTCAA
     ACCCTACGGA

1801 ATCGCCTTGC CCGAGCCTTC CCGAAAACCC CGGAAATAA
```

This encodes a protein having amino acid sequence <SEQ ID 48>:

```
  1 MLPARFTILS VLAAALLAGQ AYAAGAADVE LPKEVGKVLR
    KHRRYSEEEI

51 KNERARLAAV GERVNRVFTL LGGETALQKG QAGTALATYM
    LMLERTKSPE

101 VAERALEMAV SLNAFEQAEM IYQKWRQIEP IPGEAQKPAG
    WLRNVLKEGG

151 NQHLDGLKEV LAQSDDVQKR RIFLLLVQAA VQQGGVAQKA
    SKAVRRAALK

201 YEHLPEAAVA DAVFGVQGRE KEKAIEALQR LAKLDTEILP
    PTLMTLRLTA
```

-continued

```
251 RKYPEILDGF FEQTDTQNLS AVWQEMEIMN LVSLRKPDDA
    YARLNVLLEH

301 NPNANLYIQA AILAANRKEG ASVIDGYAEK AYGRGTGEQR
    GRAAMTAAMI

351 YADRRDYAKV RQWLKKVSAP EYLFDKGVLA AAAAAELDGG
    RAALRQIGRV

401 RKLPEQQGRY FTADNLSKIQ MLALSKLPDK REALIGLNNI
    IAKLSAAGST
```

-continued

```
451 EPLAEALAQR SIIYEQFGKR GKMIADLETA LKLTPDNAQI
    MNNLGYSLLS

501 DSKRLDEGFA LLQTAYQINP DDTAVNDSIG WAYYLKGDAE
    SALPYLRYSF

551 ENDPEPEVAA HLGEVLWALG ERDQAVDVWT QAAHLRGDKK
    IWRETLKRYG

601 IALPEPSRKP RK*
```

ORF9ng and ORF9-1 show 88.1% identity in 614 aa overlap:

```
                     10         20         30         40         50         60
orf9-1.pep  MLPNRFKMLTVLTATLIAGQVSAAGGGAGDMKQPKEVGKVFRKQQRYSEEEIKNERARLA
            ||| ||  :|:||:|:|||| |||    :|:::  |||||||||||:||::||||||||||
orf9ng-1    MLPARFTILSVLAAALLAGQAYAAG--AADVELPKEVGKVLRKHRRYSEEEIKNERARLA
                     10         20          30         40         50

70         80         90        100        110        120
orf9-1.pep  AVGERVNQIFTLLGGETALQKGQAGTALATYMLMLERTKSPEVAERALEMAVSLNAFEQA
            ||||||||::|||||||||||||||||||||||||||||||||||||||||||||||||
orf9ng-1    AVGERVNRVFTLLGGETALQKGQAGTALATYMLMLERTKSPEVAERALEMAVSLNAFEQA
                60         70         80         90        100        110

130        140        150        160        170        180
orf9-1.pep  EMIYQKWRQIEPIPGKAQKRAGWLRNVLRERGNQHLDGLEEVLAQADEGQNRRVFLLLAQ
            |||||||||||||:||| ||:|||||||:|||||||||:||||||:: |:|||:||||:|
orf9ng-1    EMIYQKWRQIEPIPGEAQKPAGWLRNVLKEGGNQHLDGLKEVLAQSDDVQKRRIFLLLVQ
              120        130        140        150        160        170

190        200        210        220        230        240
orf9-1.pep  AAVQQDGLAQKASKAVRRAALKYEHLPEAAVADVVFSVQGREKEKAIGALQRLAKLDTEI
            |||||  |:||||||||||||||||||||||||||:||:||||||||||:|||||||||||
orf9ng-1    AAVQQGGVAQKASKAVRRAALKYEHLPEAAVADAVFGVQGREKEKAIEALQRLAKLDTEI
              180        190        200        210        220        230

250        260        270        280        290        300
orf9-1.pep  LPPTLMTLRLTARKYPEILDGFFEQTDTQNLSAVWQEMEIMNLVSLHRLDDDAYARLNVLL
            ||||||||||||||||||||||||||||||||||||||||||||||::  ||||||||||
orf9ng-1    LPPTLMTLRLTARKYPEILDGFFEQTDTQNLSAVWQEMEIMNLVSLRKPDDAYARLNVLL
              240        250        260        270        280        290

310        320        330        340        350        360
orf9-1.pep  ERNPNADLYIQAAILAANRKEGASVIDGYAEKAYGRGTEEQRSRAALTAAMMYADRRDYA
            |:||||  |||||||||||||||||||||||||||||||  ||||  ||||:||||||||
orf9ng-1    EHNPNANLYIQAAILAANRKEGASVIDGYAEKAYGRGTGEQRGRAAMTAAMIYADRRDYA
              300        310        320        330        340        350

370        380        390        400        410        420
orf9-1.pep  KVRQWLKKVSAPEYLFDKGVLAAAAAVELDGGRAALRQIGRVRKLPEQQGRYFTADNLSK
            ||||||||||||||||||||||||||:|||||||||||||||||||||||||||||||||
orf9ng-1    KVRQWLKKVSAPEYLFDKGVLAAAAAAELDGGRAALRQIGRVRKLPEQQGRYFTADNLSK
              360        370        380        390        400        410

430        440        450        460        470        480
orf9-1.pep  IQMLALSKLPDKREALRGLDKIIEKPPAGSNTELQAEALVQRSVVYDRLGKRKKMISDLE
            ||||||||||||||||| |::||  |:::||  ||||||||:|:::  ||| |||:||||:|
orf9ng-1    IQMLALSKLPDKREALIGLNNIIAKLSAAGSTEPLAEALAQRSIIYEQFGKRGKMIADLE
              420        430        440        450        460        470

490        500        510        520        530        540
orf9-1.pep  RAFRLAPDNAQIMNNLGYSLLTDSKRLDEGFALLQTAYQINPDDTAVNDSIGWAYYLKGD
            |::|:||||||||||||||||:||||||||||||||||||||||||||||||||||||||
orf9ng-1    TALKLTPDNAQIMNNLGYSLLSDSKRLDEGFALLQTAYQINPDDTAVNDSIGWAYYLKGD
              480        490        500        510        520        530

550        560        570        580        590        600
orf9-1.pep  AESALPYLRYSFENDPEPEVAAHLGEVLWALGERDQAVDVWTQAAHLTGDKKIWRETLKR
            |||||||||||||||||||||||||||||||||||||||||||||||| |||||||||||
orf9ng-1    AESALPYLRYSFENDPEPEVAAHLGEVLWALGERDQAVDVWTQAAHLRGDKKIWRETLKR
              540        550        560        570        580        590

610
orf9-1.pep  HGIALPQPSRKPRKX
            :||||| :|||||||
orf9ng-1    YGIALPEPSRKPRKX
              600        610
```

In addition, ORF9ng shows significant homology with a hypothetical protein from *P. aeruginosa*:

```
sp|P42810|YHE3_PSEAE HYPOTHETICAL 64.8 KD PROTEIN IN HEMM-HEMA
INTERGENIC REGION (ORF3)
>gi|1072999|pir| |S49376 hypothetical protein 3 - Pseuclomonas aeruginosa
>gi|557259 (X82071) orf3 [Pseudomonas aeruginosa] Length = 576
 Score = 128 bits (318), Expect = 1e-28
 Identities = 138/587 (23%), Positives = 228/587 (38%),
Gaps = 125/587 (21%)

Query:  67 VFTLLGGETALQKGQAGTALATYMLMLERTKSPEVAERALEMAVSLNAFEQAEMIYQKWR 126
            +++LL  E A Q+ +    AL+ Y++  ++T+ P V+ERA  +A  L A ++A      W
Sbjct:  53 LYSLLVAELAGQRNRFDIALSNYVVQAQKTRDPGVSERAFRIAEYLGADQEALDTSLLWA 112

Query: 127 QIEPIPGEAQKPAG--------------WLRNVLKEGGNQHLDGLKEVLAQSDDVQKRRI 172
            +  P  +AQ+ A              ++ VL  G+H D L   A++D   +  +
Sbjct: 113 RSAPDNLDAQRAAAIQLARAGRYEESMVYMEKVLNGQGDTHFDFLALSAAETDPDTRAGL 172

Query: 173 FXXXXXXXXXXXXXXXXKASKAVRRAALKYEHLPEAAVADAVFGVQGREKEKAIEALQRLA 232
                ++         KY +  +    A+  Q   ++A+ L+ +
Sbjct: 173 L----------------QSFDHLLKKYPNNGQLLFGKALLLQQDGRPDEALTLLEDNS 214

Query: 233 KLDTEILPPTLMTLRLTARK-----YPEILDGFFEQTDTQNLSAVWQEMEIMNLVSLRKP 287
            E+ P  L+  L +K        P + G E D + +  + +  LV +
Sbjct: 215 ASRHEVAPLLLRSLLQSMKRSDEALPLLKAGIKEHPDDKRVRLAYARL----LVEQNRL 270

Query: 288 DDAYARLNVLLEHNPN--------------------ANLYIQAAI-------------- 312
            DDA A   L++ P+                    A +Y++  +
Sbjct: 271 DDAKAEFAGLVQQFPDDDDDLRFSLALVCLEAQAWDEARIYLEELVERDSHVDAAHFNLG 330

Query: 313 -LAANRKEGASVIDGYAEKAYGRGTGEQRGRAANTAAMIYADRRDYAKVRQWLKKVSAPE 371
             LA  +K+ A  +D YA+  G G     +  T ++A R D A R    +   P+
Sbjct: 331 RLAEEQKDTARALDEYAQ--VGPGNDFLPAQLRQTDVLLKAGRVDEAAQRLDKARSEQPD 388

Query: 372 YLFDKXXXXXXXXXXXXXXXXXXXRQIGRVRKLPEQQGRYFTADNLSKIQMLALSKLPDKR 431
            Y                                        A  L I+  ALS     +
Sbjct: 389 Y----------------------------------------AIQLYLIEAEALSNNDQQE 408

Query: 432 EALIGLNNIIAKLSAAGSTEPLAEALAQRSIIYEQFGKRGKNIADLETALKLTPDNAQIM 491
            +A   + +  ++        E L   L RS++ E+    +M DL   + PDNA +
Sbjct: 409 KAWQAIQEGLKQYP-----EDL-NLLYTRSMLAEKRNDLAQMEKDLRFVIAREPDNANAL 462

Query: 492 NNLGYSLLSDSKRLDEGFALLQTAYQINPDDTAVNDSIGWAYYLKGDAESALPYLRYSFE 551
            N LGY+L  + R E   L+ A+++NPDD A+ DS+GW  Y +G    A  YLR + +
Sbjct: 463 NALGYTLADRTTRYGEARELILKAHKLNPDDPAILDSMGWINYRQGKLADAERYLRQALQ 522

Query: 552 NDPEPEVAAHLGEVLWALGERDQAVDVWTQAAHLRGDKKIWRETLKR              598
            P+  EVAAHLGEVLWA G + A +W +    + D  + R T+KR
Sbjct: 523 RYPDHEVAAHLGEVLWAQGRQGDARAIWREYLDKQPDSDVLRRTIKR              569 gi|2983399 (AE000710) hypothetical protein [Aquifex aeolicus] Length = 545
 Score = 81.5 bits (198), Expect = 1e-14
 Identities = 61/198 (30%), Positives = 98/198 (48%), Gaps = 19/198 (9%)

Query: 408 GRYFTADNL-SKIQMLALSKLPDKREALIGLNNIIAKLSAAGSTEPLAEALAQ------- 459
             G Y  A  L K ++LA    PDK+E L   +K        + + L +
Sbjct: 335 GNYEDAKRLIEKAKVLA----PDKKEILFLEADYYSKTKQYDKALEILKKLEKDYPNDSR 390

Query: 460 ----RSIIYEQFGKRGKMIADLETALKLTPDNAQIMNNLGYSLLS--DSKRLDEGFALLQ 513
                 +I+Y+  G      L A++L P+N    N LGYSLL    R++E    L++
Sbjct: 391 VYFMEAIVYDNLGDIKNAEKALRKAIELDPENPDYYNYLGYSLLLWYGKERVEEAEELIK 450

Query: 514 TAYQINPDDTAVNDSIGWAYYLKGDAESALPYLRYSF-ENDPEPEVAAHLGEVLWALGER 572
             A + +P++ A  DS+GW YYLKGD E A+ YL +    E   +P V H+G+VL  +G +
Sbjct: 451 KALEKDPENPAYIDSMGWVYYLKGDYERAMQYLLKALREAYDDPVVNEHVGDVLLKMGYK 510

Query: 573 DQAVDVWTQAAHLRGDKK                                           590
            ++A + + +A L  +K
Sbjct: 511 EEARNYYERALKLLEEGK                                           528
```

Based on this analysis, it is predicted that the proteins from *N. meningitidis* and *N. gonorrhoeae*, and their epitopes, could be useful antigens for vaccines or diagnostics, or for raising antibodies.

Example 7

The following partial DNA sequence was identified in *N. meningitidis* <SEQ ID 49>:

```
  1 AACCTCTACG CCGGCCCGCA GACCACATCC GTCATCGCAA
    ACATCGCCGA
 51 CAACCTGCAA CTGCCCAAAG ACTACCGCAA AGTACACTGG
    TTCGCCTCCC
101 CGCTCTTCTG GCTCCTGAAC CAACTGCACA ACATCATCGG
    CAACTGGGCC
151 TGCCCGATTA TCGTTTTAAC CATCATCGTC AAACCCGTAC
    TGTATCCATT
201 GACCAACGCC TCTTACCGCT CTATGGCGAA AATGCGTCCC
    GCCGCACCCA
251 AACTGCAAGC CATCAAAGAG AAATACGCCG ACGACCGTAT
    CGCGCAACAA
301 CAGGCGATGA TGCAGCTTTA CACAGACGAG AAAATCAACC
    CGaCTGGGCG
351 GCTGCCTGCC TATGCTGTTG CAAATCCCCG TCTTCATCGG
    ATTGTATTGG
401 GCATTGTTCG CCTCCGTAGA ATTGCGCCAG GCACCTTGGC
    TGGGTTGGAT
451 TACCGACCTC AGCCGCGCCG ACCCCTACTA CATCCTGCCC
    ATCATTATGG
501 CGGCAACGAT GTTCGCCCAA ACTTATCTGA ACCCGCCGCC
    GAcCGACCCG
551 ATGCagGCGA AAATGATGAA AATCATGCCG TTGGTTTTCT
    CsGwCrTGTT
601 CTTCTTCTTC CCTGCCGGks TGGTATTGTA CTGGGTAGTC
    AACAACCTCC
651 TGACCATCGC CCAGCAATGG CACATCAACC GCAGCATCGA
    AAAACAACGC
701 GCCCAAGGCG AAGTCGTTTC CTAA
```

This corresponds to the amino acid sequence <SEQ ID 50; ORF11>:

```
  1 ..NLYAGPQTTS VIANIADNLQ LAKDYGKVHW FASFLFWLLN
    QLHNIIGNWG
 51 WAIIVLTIIV KAVLYPLTNA SYRSMAKMRA AAPKLQAIKE
    KYGDDRMAQQ
101 QAMMQLYTDE KINPLGGCLP MLLQIPVFIG LYWALFASVE
    LRQAPWLGWI
151 TDLSRADPYY ILPIIMAATM FAQTYLNPPP TDPMQAKMMK
    IMPLVFSXXF
201 FFFPAGXVLY WVVNNLLTIA QQWHINRSIE KQRAQGEVVS
    *
```

Further sequence analysis revealed the complete DNA sequence <SEQ ID 51>:

```
   1 ATGCATTTTA AAAGACTCAC GCCGTTTTTC GCCATCGCGC
     TGGTGATTAT
  51 GATCGGCTGG GAAAAGATGT TCCCCACTCC GAAGCCAGTC
     CCCGCCCCCC
 101 AACAGGCAGC ACAACAACAG GCCGTAACCG CTTCCGCCGA
     AGCCCCGCTC
 151 GCGCCCGCAA CGCCGATTAC CGTAACGACC GACACGGTTC
     AAGCCGTCAT
 201 TGATGAAAAA AGCGGCGACC TGCGCCGGCT GACCCTGCTC
     AAATACAAAG
 251 CAACCGGCGA CGAAAATAAA CCGTTCATCC TGTTTGGCGA
     CGGCAAAGAA
 301 TACACCTACG TCGCCCAATC CGAACTTTTG GACGCGCAGG
     GCAACAACAT
 351 TCTAAAAGGC ATCGGCTTTA GCGCACCGAA AAAACAGTAC
     AGCTTGGAAG
 401 GCGACAAAGT TGAAGTCCGC CTGAGCGCGC CTGAAACACG
     CGGTCTGAAA
 451 ATCGACAAAG TTTATACTTT CACCAAAGGC AGCTATCTGG
     TCAACGTCCG
 501 CTTCGACATC GCCAACGGCA GCGGTCAAAC CGCCAACCTG
     AGCGCGGACT
 551 ACCGCATCGT CCGCGACCAC AGCGAACCCG AGGGTCAAGG
     TTACTTTACC
 601 CACTCTTACG TCGGCCCTGT TGTTTATACC CCTGAAGGCA
     ACTTCCAAAA
 651 AGTCAGCTTT TCCGACTTGG ACGACGATGC CAAATCCGGC
     AAATCCGAGG
 701 CCGAATACAT CCGCAAAACC CCGACCCGCT GGCTCGGCAT
     GATTGAACAC
 751 CACTTCATGT CCACCTGGAT TCTCCAACCT AAAGGCAGAC
     AAAGCGTTTG
 801 CGCCGCAGGC GAGTGCAACA TCGACATCAA ACGCCGCAAC
     GACAAGCTGT
 851 ACAGCACCAG CGTCAGCGTG CCTTTAGCCG CCATCCAAAA
     CGGCGCGAAA
 901 GCCGAAGCCT CCATCAACCT CTACGCCGGC CCGCAGACCA
     CATCCGTCAT
 951 CGCAAACATC GCCGACAACC TGCAACTGGC CAAAGACTAC
     GGCAAAGTAC
1001 ACTGGTTCGC CTCCCCGCTC TTCTGGCTCC TGAACCAACT
     GCACAACATC
1051 ATCGGCAACT GGGGCTGGGC GATTATCGTT TTAACCATCA
     TCGTCAAAGC
1101 CGTACTGTAT CCATTGACCA ACGCCTCTTA CCGCTCTATG
     GCGAAAATGC
1151 GTGCCGCCGC ACCCAAACTG CAAGCCATCA AAGAGAAATA
     CGGCGACGAC
1201 CGTATGGCGC AACAACAGGC GATGATGCAG CTTTACACAG
     ACGAGAAAAT
1251 CAACCCGCTG GGCGGCTGCC TGCCTATGCT GTTGCAAATC
     CCCGTCTTCA
1301 TCGGATTGTA TTGGGCATTG TTCGCCTCCG TAGAATTGCG
     CCAGGCACCT
```

```
1351 TGGCTGGGTT GGATTACCGA CCTCAGCCGC GCCGACCCCT
     ACTACATCCT

1401 GCCCATCATT ATGGCGGCAA CGATGTTCGC CCAAACTTAT
     CTGAACCCGC

1451 CGCCGACCGA CCCGATGCAG GCGAAAATGA TGAAAATCAT
     GCCGTTGGTT

1501 TTCTCCGTCA TGTTCTTCTT CTTCCCTGCC GGTCTGGTAT
     TGTACTGGGT

1551 AGTCAACAAC CTCCTGACCA TCGCCCAGCA ATGGCACATC
     AACCGCAGCA

1601 TCGAAAAACA ACGCGCCCAA GGCGAAGTCG TTTCCTAA
```

This corresponds to the amino acid sequence <SEQ ID 52; ORF11-1>:

```
  1 MDFKRLTAFF AIALVIMIGW EKMFPTPKFV PAPQQAAQQQ
    AVTASAEAAL

51 APATPITVTT DTVQAVIDEK SGDLRRLTLL KYKATGDENK
    PFILFGDGKE

101 YTYVAQSELL DAQGNNILKG IGFSAPKKQY SLEGDKVEVR
    LSAPETRGLK

151 IDKVYTFTKG SYLVNVRFDI ANGSGQTANL SADYRIVRDH
    SEPEGQGYFT

201 HSYVGPVVYT PEGNFQKVSF SDLDDDAKSG KSEAEYIRKT
    PTGWLGMIEH

251 HFMSTWILQP KGRQSVCAAG ECNIDIKRRN DKLYSTSVSV
    PLAAIQNGAK

301 AEASINLYAG PQTTSVIANI ADNLQLAKDY GKVHWFASPL
    FWLLNQLHNI

351 IGNWGWAIIV LTIIVKAVLY PLTNASYRSM AKMRAAAPKL
    QAIKEKYGDD

401 RNAQQQMMQ LYTDEKINPL GGCLPMLLQI PVFIGLYWAL
    FASVELRQAP

451 WLGWITDLSR ADPYYILPII MAATMFAQTY LNPPPTDPMQ
    AKMMKIMPLV

501 FSVMFFFFPA GLVLYWVVNN LLTIAQQWHI NRSIEKQRAQ
    GEVVS*
```

Computer analysis of this amino acid sequence gave the following results:

Homology with a 60 kDa Inner-Membrane Protein (Accession P25754) of *Pseudomonas putida*

ORF11 and the 60 kDa protein show 58% aa identity in 229 aa overlap (BLASTp).

```
ORF11    2 LYAGPQTTSVIANIADNLQLAKDYGKVHWFASPLFWLLNQLHNIIGNWGWAIIVLTIIVK   61
           LYAGP+  S +  ++  L+L  DYG + + A P+FWLL  +H+++GNWGW+IIVLT+++K
60K    324 LYAGPKIQSKLKELSPGLELTVDYGFLWFIAQFIFWLLQHIHSLLGNWGWSIIVLTMLIK  383

ORF11   62 AVLYPLTNASYRSMAKMRAAAPKLQAIKEKYGDDRXXXXXXXXXXLYTDEKINPLGGCLPM 121
            + +PL+ ASYRSMA+MRA APKL A+KE++GDDR          LY EKINPLGGCLP+
60K    384 GLFFPLSAASYRSMARMRAVAPKLAALKERFGDDRQKMSQAMMELYKKEKINPLGGCLPI 443

ORF11  122 LLQIPVFIGLYWALFASVELRQAPWLGWITDLSRADPYYILPIIMAATMFAQTYLNPPPT 181
           L+Q+PVF+ LYW L  SVE+RQAPW+ WITDLS DP++ILPIIM ATMF Q  LNP P
60K    444 LVQMPVFLALYWVLLESVEMRQAPWILWITDLSIKDPFFILPIIMGATMFIQQRLNPTPP 503

ORF11  182 DPMQAKMMKIMFLVXXXXXXXXXPAGXVLYWVVNNLLTIAQQWHINRSIE           230
           DPMQAK+MK+MP++         PAG VLYWVVNN L+I+QQW+I R IE
60K    504 DPMQAKVMKMMPIIFTFFFLWFPAGLVLYWVVNNCLSISQQWYITRRIE            552
```

Homology with a Predicted ORF from *N. meningitidis* (Strain A)

ORF11 shows 97.9% identity over a 240aa overlap with an ORF (ORF11a) from strain A of *N. meningitidis*:

```
                                       10        20        30
orf11.pep                     NLYAGPQTTSVIANIADNLQLAKDYGKVHW
                              |||||||||||||||||||| |||||||||
orf11a    IKRRNDKLYSTSVSVPLAAIQNGAKSXASINLYAGPQTTSVIANIADNLXKDYGKVHW
                 280       290       300       310       320       330

40        50        60        70        80        90
orf11.pep  FASPLFWLLNQLHNIIGNWGWAIIVLTIIVKAVLYPLTNASYRSMAKMRAAAPKLQAIKE
           ||||||||||||||||||||||||||||||||||||||||||||||||||||||||||||
orf11a     FASPLFWLLNQLHNIIGNWGWAIIVLTIIVKAVLYPLTNASYRSMAKMRAAAPKLQAIKE
              340       350       360       370       380       390
```

```
                   100        110        120        130        140        150
orf11.pep  KYGDDRMAQQQAMMQLYTDEKINPLGGCLPMLLQIPVFIGLYWALFASVELRQAPWLGWI
           |||||||||||||||||||||||||||||||||||||||||||||||||||||||||||
orf11a     KYGDDRMAQQQAMMQLYTDEKINPLGGCLPMLLQIPVFIGLYWALFASVELRQAPWLGWI
                   400        410        420        430        440        450
                   160        170        180        190        200        210
orf11.pep  TDLSRADPYYILPIIMAATMFAQTYLNPPPTDPMQAKMMKIMPLVFSXXFFFFPAGXVLY
           ||||||||||||||||||||||||||||||||||||||||||||| ||||| |||  |||
orf11a     TDLSRADPYYILPIIMAATMFAQTYLNPPPTDPMQAKMMKIMPLVXSXXFFXFPAGLVLY
                   460        470        480        490        500        510
                   220        230        240
orf11.pep  WVVNNLLTIAQQWHINRSIEKQRAQGEVVSX
           || :||||||||||||||||||||||||||
orf11a     WVINNLLTIAQQWHINRSIEKQRAQGEVVSX
                   520        530        540
```

The complete length ORF11a nucleotide sequence <SEQ ID 53> is:

```
   1 ANGGATTTTA AAAGACTCAC NGNGTTTTTC GCCATCGCAC
     TGGTGATTAT
  51 GATCGGATNG NAAANGATGT TCCCCACTCC GAAGCCCGTC
     CCCGCGCCCC
 101 AACAGACGGC ACAACAACAG GCCGTAANCG CTTCCGCCGA
     AGCCGCGCTC
 151 GCGCCCGNAN CGCCGATTAC CGTAACGACC GACACGGTTC
     AAGCCGTCAT
 201 TGATGAAAAA AGCGGCGACC TGCGCCGGCT GACCCTGCTC
     AAATACAAAG
 251 CAACCGGCGA CNAAAATAAA CCGTTCATCC TGTTTGGCGA
     CGGCAAANAA
 301 TACACCTACN TCGCCCANTC CGAACTTTTG GACGCGCAGG
     GCAACAACAT
 351 TCTAAAAGGC ATCGGCTTTA GCGCACCGAA AAAACAGTAC
     AGCTTGGAAG
 401 GCGACAAAGT TGAAGTCCGC CTGAGCGCAC CTGAAACACG
     CGGTCTGAAA
 451 ATCGACAAAG TTTATACTTT CACCAAAGGC AGCTATCTGG
     TCAACGTCCG
 501 CTTCGACATC GCCAACGGCA GCGGTCAAAC CGCCAACCTG
     AGCGCGGACT
 551 ACCGCATCGT CCGCGACCAC AGCGAACCCG AGGGTCAAGG
     CTACTTTACC
 601 CACTCTTACG TCGGCCCTGT TGTTTATACC CCTGAAGGCA
     ACTTCCAAAA
 651 AGTCAGCTTC TCCGACTTGG ACGACGATCC CAANTCCGGN
     AAATCCGAGG
 701 CCGAATACAT CCGCAAAACC CNGACCGGCT GGCTCGGCAT
     GATTGAACAC
 751 CACTTCATGT CCACCTGGAT CCTCCAACCC AAAGGCGGAC
     AAAGCGTTTG
 801 CGCCGCTGGC GACTGCNGTA TNGACATCAA ACGCCGCAAC
     GACAAGCTGT
 851 ACAGCACCAG CGTCAGCGTG CCTTTAGCCG CTATCCAAAA
     CGGTGCGAAA
 901 TCCNAAGCCT CCATCAACCT CTACGCCGGC CCACAGACCA
     CATCNGTTAT
 951 CGCAAACATC GCCGACAACC TGCAACTGGN CAAAGACTAC
     GGCAAAGTAC
1001 ACTGGTTCGC CTCCCCCCTC TTTTGGCTTT TGAACCAACT
     GCACAACATC
1051 ATCGGCAACT GGGGCTGGGC GATTATCGTT TTAACCATCA
     TCGTCAAAGC
1101 CGTACTGTAT CCATTGACCA ACGCCTCTTA CCGTTCGATG
     GCGAAAATGC
1151 GTGCCGCCGC GCCCAAACTG CAAGCCATCA AAGAGAAATA
     CGGCGACGAC
1201 CGTATGGCGC AGCAACAAGC CATGATGCAG CTTTACACAG
     ACGAGAAAAT
1251 CAACCCGCTG GGCGGCTGCC TGCCTATGCT GTTGCAAATC
     CCCGTCTTCA
1301 TCGGATTGTA TTGGGCATTG TTCGCCTCCG TAGAATTGCG
     CCAGGCACCT
1351 TGGCTGGGTT GGATTACCGA CCTCAGCCGC GCCGACCCNT
     ACTACATCCT
1401 GCCCATCATT ATGGCGGCAA CGATGTTCGC CCAAACCTAT
     CTGAACCCGC
1451 CGCCGACCGA CCCGATGCAG GCGAAAATGA TGAAAATCAT
     GCCTTTGGTT
1501 NTNTCNNNNA NGTTCTTCNN CTTCCCTCCC GGTCTGGTAT
     TGTACTGGGT
1551 GATCAACAAC CTCCTGACCA TCGCCCAGCA ATGGCACATC
     AACCGCAGCA
1601 TCGAAAAACA ACGCGCCCAA GGCGAAGTCG TTTCCTAA
```

This encodes a protein having amino acid sequence <SEQ ID 54>:

```
  1 XDFKRLTXFF AIALVIMIGX XXMFPTPKPV PAPQQTAQQQ
    AVXASAEAAL

51 APXXFITVTT DTVQAVIDEK SGDLRRLTLL KYKATGDXNK
    PFILFGDGKX

101 YTYXAXSELL DAQGNNILKG IGFSAPKKQY SLEGDKVEVR
    LSAPETRGLK

151 IDKVYTFTKG SYLVNVRFDI ANGSGQTANL SADYRIVRDH
    SEPEGQGYFT
```

-continued
```
201 HSYVGPVVYT PEGNFQKVSF SDLDDDAXSG KSEAEYIRKT
    XTGWLGMIEH

251 HFMSTWILQP KGGQSVCAAG DCXXDIKRRN DKLYSTSVSV
    PLAAIQNGAK

301 SXASINLYAG PQTTSVIANI ADNLQLXKDY GKVHWFASPL
    FWLLNQLHNI

351 IGNWGWAIIV LTIIVKAVLY PLTNASYRSM AKMRAAAPKL
    QAIKEKYGDD
```

-continued
```
401 RMAQQQAMMQ LYTDEKINPL GGCLPMLLQI PVFIGLYWAL
    FASVELRQAP

451 WLGWITDLSR ADPYYILPII MAATMFAQTY LNPPPTDPMQ
    AKMMKIMPLV

501 XSXXFFXFPA GLVLYWVINN LLTIAQQWHI NRSIEKQRAQ
    GEVVS*
```

ORF11a and ORF11-1 show 95.2% identity in 544 aa overlap:

```
                       10         20         30         40         50         60
orf11a.pep    XDFKRLTXFFAIALVIMIGXXXMFPTPKPVPAPQQTAQQQAVXASAEAALAPXXPITVTT
              ||||||  |||||||||||   ||||||||||||||:|||||:||||||||||  :|||||
orf11-1       MDFKRLTAFFAIALVIMIGWEKMFPTPKPVPAPQQAAQQQAVTASAEAALAPATPITVTT
                       10         20         30         40         50         60

70         80         90        100        110        120
orf11a.pep    DTVQAVIDEKSGDLRRLTLLKYKATGDXNKPFILFGDGKXYTYXAXSELLDAQGNNILKG
              ||||||||||||||||||||||||||||| ||||||||| |||| | |||||||||||||
orf11-1       DTVQAVIDEKSGDLRRLTLLKYKATGDENKPFILFGDGKEYTYVAQSELLDAQGNNILKG
                       70         80         90        100        110        120

130        140        150        160        170        180
orf11a.pep    IGFSAPKKQYSLEGDKVEVRLSAPETRGLKIDKVYTFTKGSYLVNVRFDIANGSGQTANL
              ||||||||||||||||||||||||||||||||||||||||||||||||||||||||||||
orf11-1       IGFSAPKKQYSLEGDKVEVRLSAPETRGLKIDKVYTFTKGSYLVNVRFDIANGSGQTANL
                      130        140        150        160        170        180

190        200        210        220        230        240
orf11a.pep    SADYRIVRDHSEPEGQGYFTHSYVGPVVYTPEGNFQKVSFSDLDDDAXSGKSEAEYIRKT
              |||||||||||||||||||||||||||||||||||||||||||||| ||||||||||||
orf11-1       SADYRIVRDHSEPEGQGYFTHSYVGPVVYTPEGNFQKVSFSDLDDDAKSGKSEAEYIRKT
                      190        200        210        220        230        240

250        260        270        280        290        300
orf11a.pep    XTGWLGMIEHHFMSTWILQPKGGQSVCAAGDCXXDIKRRNDKLYSTSVSVPLAAIQNGAK
               |||||||||||||||||||||| |||||||:| |||||||||||||||||||||||||
orf11-1       PTGWLGMIEHHFMSTWILQPKGRQSVCAAGECNIDIKRRNDKLYSTSVSVPLAAIQNGAK
                      250        260        270        280        290        300

310        320        330        340        350        360
orf11a.pep    SXASINLYAGPQTTSVIANIADNLQLXKDYGKVHWFASPLFWLLNQLHNIIGNWGWAIIV
              :|||||||||||||||||||||||| ||||||||||||||||||||||||||||||||||
orf11-1       AEASINLYAGPQTTSVIANIADNLQLAKDYGKVHWFASPLFWLLNQLHNIIGNWGWAIIV
                      310        320        330        340        350        360

370        380        390        400        410        420
orf11a.pep    LTIIVKAVLYPLTNASYRSMAKMRAAAPKLQAIKEKYGDDRMAQQQAMMQLYTDEKINPL
              ||||||||||||||||||||||||||||||||||||||||||||||||||||||||||||
orf11-1       LTIIVKAVLYPLTNASYRSMAKMRAAAPKLQAIKEKYGDDRMAQQQAMMQLYTDEKINPL
                      370        380        390        400        410        420

430        440        450        460        470        480
orf11a.pep    GGCLPMLLQIPVFIGLYWALFASVELRQAPWLGWITDLSRADPYYILPIIMAATMFAQTY
              ||||||||||||||||||||||||||||||||||||||||||||||||||||||||||||
orf11-1       GGCLPMLLQIPVFIGLYWALFASVELRQAPWLGWITDLSRADPYYILPIIMAATMFAQTY
                      430        440        450        460        470        480

490        500        510        520        530        540
orf11a.pep    LNPPPTDPMQAKMMKIMPLVXSXXFFXFPAGLVLYWVINNLLTIAQQWHINRSIEKQRAQ
              |||||||||||||||||||| ||  |||||||||||||:|||||||||||||||||||||
orf11-1       LNPPPTDPMQAKMMKIMPLVFSVMFFFFPAGLVLYWVVNNLLTIAQQWHINRSIEKQRAQ
                      490        500        510        520        530        540 orf11a.pep    GEVVSX
              ||||||
orf11-1       GEVVSX
```

Homology with a Predicted ORF from *N. gonorrhoeae*
ORF11 shows 96.3% identity over a 240aa overlap with a predicted ORF (ORF11.ng) from *N. gonorrhoeae*:

```
orf11      NLYAGPQTTSVIANIADNLQLAKDYGKVHWFASPLFWLLNQLHNIIGNWGWAIIVLT   57
           ||||||||||||||||||||||||||||||||||||||||||||||||||||:|||
orf11ng  MAVNLYAGPQTTSVIANIADNLQLAKDYGKVHWFASPLFWLLNQLHNIIGNWGWAIVVLT   60
orf11      IIVKAVLYPLTNASYRSMAKMRAAAPKLQAIKEKYGDDRMAQQQAMMQLYTDEKINPLGG  117
           ||||||||||||||||||||||||||||:||:||||||||||||||||||:||:||||||
orf11ng    IIVKAVLYPLTNASYRSMAKMRAAAPELQTIKEKYGDDRMAQQQAMMQLFEDEEINPLGG  120
orf11      CLPMLLQIPVFIGLYWALFASVELRQAPWLGWITDLSRADPYYILPIIMAATMFAQTYLN  177
           ||||||||||||||||||||||||||||||||||||||||||||||||||||||||||||
orf11ng    CLPMLLQIPVFIGLYWALFASVELRQAPWLGWITDLSRADPYYILPIIMAATMFAQTYLN  180
orf11      PPPTDPMQAKMMKIMPLVFSXXFFFFPAGXVLYWVVNNLLTIAQQWHINRSIEKQRAQGE  237
           |||||||||||||||||||||| ||||||| |||||||||||||||||||||||||||||
orf11ng    PPPTDPMQAKMMKIMPLVFSVMFFFFPAGLVLYWVVNNLLTIAQQWHINRSIEKQRAQGE  240
orf11      VVS  240
           |||
orf11ng    VVS  243
```

An ORF11ng nucleotide sequence <SEQ ID 55> was predicted to encode a protein having amino acid sequence <SEQ ID 56>:

```
  1 MAVNLYAGPQ TTSVIANIAD NLQLAKDYGK VHWFASPLFW
    LLNQLHNIIG

51 NWGWAIVVLT IIVKAVLYPL TNASYRSMAK MRAAAPELQT
    IKEKYGDDRM

101 AQQQANMQLF EDEEINFLGG CLPMLLQIPV FIGLYWALFA
    SVELRQAPWL

151 GWITDLSRAD PYYILPIIMA ATMFAQTYLN PPPTDPMQAK
    MMKIMPLVFS

201 VMFFFFPAGL VLYWVVNNLL TIAQQWHINR SIEKQRAQGE
    VVS*
```

Further sequence analysis revealed the complete gonococcal DNA sequence <SEQ ID 57> to be:

```
   1 ATGGATTTTA AAAGACTCAC GGCGTTTTTC GCCATCGCGC
     TGGTGATTAT

51 GATCGGCTGG GAAAAAATGT TCCCCACCCC GAAACCCGTC
     CCCGCGCCCC

101 AACAGGCGGC ACAAAAACAG GCAGCAACCG CTTCCGCCGA
     AGCCGCGCTC

151 GCGCCCGCAA CGCCGATTAC CGTAACGACC GACACGGTTC
     AAGCCGTTAT

201 TGATGAAAAA AGTGGCGACC TGCGCCGGCT GACCCTGCTC
     AAATACAAAG

251 CAACCGGCGA CGAAAACAAA CCGTTCGTCC TGTTTGGCGA
     CGGCAAAGAA

301 TACACCTACG TCGCCCAATC CGAACTTTTG GACGCGCAGG
     GCAACAACAT

351 TCTGAAAGGC ATCGGCTTTA GCGCACCGAA AAAACAGTAC
     ACCCTCAACG

401 GCGCACACAGT CGAAGTCCGC CTGAGCGCGC CCGAAACCAA
     CGGACTGAAA

451 ATCGACAAAG TCTATACCTT TACCAAAGAC AGCTATCTGG
     TCAACGTCCG

501 CTTCGACATC GCCAACGGCA GCGGTCAAAC CGCCAACCTG
     AGCGCGGACT

551 ACCGCATCGT CCGCGACCAC AGCGAACCCG AGGGTCAAGG
     CTACTTTACC

601 CACTCTTACG TCGGCCCTGT TGTTTATACC CCTGAAGGCA
     ACTTCCAAAA

651 AGTCAGCTTC TCCgacTTqg acgACGATGC gaaaTccggc
     aaATCcgagg 701 ccgaatacaT CCGCAAAACC ccgaccggtt ggctcggcat
     gattgaacac 751 cacttcatgt ccacctggat cctccAAcct aaaggcggcc
     aaaacgtttg 801 cgcccaggga gactgccgta tcgacattaa aCgccgcaac
     gacaagctgt 851 acagcgcaag cgtcagcgtg cctttaaccg ctatcccaac
     ccgggggcca 901 aaaccgaaaa tggcggTCAA CCTGTATGCC GGTCCGCAAA
     CCACATCCGT 951 TATCGCAAAC ATCGCcgacA ACCTGCAACT GGCAAAAGAC
     TACGGTAAAG

1001 TACACTGGTT CGCATCGCCG CTCTTCTGGC TCCTGAACCA
     ACTGCACAAC

1051 ATTATCGGCA ACTGGGGCTG GCAATCGTC GTTTTGACCA
     TCATCGTCAA

1101 AGCCGTACTG TATCCATTGA CCAACGcctc ctACCGTTCG
     ATGGCGAAAA

1151 TGCGTGCcgc cgcacCcaaA CTGCAGACCA TCAAAGAAAA
     ATACgGCGAC

1201 GACCGTATGG CGCAACAGCA AGCGATGATG CAGCTTTACA
     AAgacgAGAA

1251 AATCAACCCG CTGGGCGGCT GTctgcctat gctgttgCAA
     ATCCCCGTCT
```

```
1301 TCATCGGCTT GTACTGGGCA TTGTTCGCCT CCGTAGAATT
     GCGCCAGGCA

1351 CCTTGGCTGG GCTGGATTAC CGACCTCAGC CGCGCCGACC
     CCTACTACAT

1401 CCTGCCCATC ATTATGGCCG CAACGATGTT CGCCCAAACC
     TATCTGAACC

1451 CGCCGCCGAC CGACCCGATG CAGGCGAAAA TGATGAAAAT
     CATGCCGTTG

1501 GTTTTCTCCG TCATGTTCTT CTTCTTCCCT GCCGGTTTGG
     TTCTCTACTG

1551 GGTGGTCAAC AACCTCCTGA CCATCGCCCA GCAGTGGCAC
     ATCAACCGCA

1601 GCATCGAAAA ACAACGCGCC CAAGGCGAAG TCGTTTCCTA
     A
```

This encodes a protein having amino acid sequence <SEQ ID 58; ORF11ng-1>:

```
  1 MDFKRLTAFF AIALVIMIGW EKMFPTPKPV PAPQQAAQKQ
    AATASAEAAL
 51 APATPITVTT DTVQAVIDEK SGDLRRLTLL KYKATGDENK
    PFVLFGDGKE
101 YTYVAQSELL DAQGNNTLKG IGFSAPKKQY TLNGDTVEVR
    LSAPETNGLK
151 IDKVYTFTKD SYLVNVRFDI ANGSGQTANL SADYRIVRDH
    SEPEGQGYFT
201 HSYVGPVVYT PEGNFQKVSF SDLDDDAKSG KSEAEYIRKT
    PTGWLGMIEH
251 HFMSTWILQP KGGQNVCAQG DCRIDIKRRN DKLYSASVSV
    PLTAIPTRGP
301 KPKMAVNLYA GPQTTSVIAN IADNLQLAKD YGKVHWFASP
    LFWLLNQLHN
351 IIGNWGWAIV VLTIIVKAVL YPLTNASYRS MAKMRAAAPK
    LQTIKEKYGD
401 DRMAQQQAMM QLYKDEKINP LGGCLPMLLQ IPVFIGLYWA
    LFASVELRQA
451 PWLGWITDLS RADPYYILPI IMAATMFAQT YLNPPPTDPM
    QAKMMKIMPL
501 VFSVMFFFFP AGLVLYWVVN NLLTTAQQWH INRSIEKQRA
    QGEVVS*
```

ORF11ng-1 and ORF11-1 shown 95.1% identity in 546 aa overlap:

```
                  10         20         30         40         50         60
orf11ng-1.pep  MDFKRLTAFFAIALVIMIGWEKMFPTPKPVPAPQQAAQKQAATASAEAALAPATPITVTT
               ||||||||||||||||||||||||||||||||||||:||:||||||||||||||||||||
orf11-1        MDFKRLTAFFAIALVIMIGWEKMFPTPKPVPAPQQAAQQQAVTASAEAALAPATPITVTT
                  10         20         30         40         50         60

70         80         90        100        110        120
orf11ng-1.pep  DTVQAVIDEKSGDLRRLTLLKYKATGDENKPFVLFGDGKEYTYVAQSELLDAQGNNILKG
               ||||||||||||||||||||||||||||||||:|||||||||||||||||||||||||||
orf11-1        DTVQAVIDEKSGDLRRLTLLKYKATGDENKPFILFGDGKEYTYVAQSELLDAQGNNILKG
                  70         80         90        100        110        120

130        140        150        160        170        180
orf11ng-1.pep  IGFSAPKKQYTLNGDTVEVRLSAPETNGLKIDKVYTFTKDSYLVNVRFDIANGSGQTANL
               |||||||||:|:||||||||||||||:|||||||||||:|||||||||||||||||||||
orf11-1        IGFSAPKKQYSLEGDKVEVRLSAPETRGLKIDKVYTFTKGSYLVNVRFDIANGSGQTANL
                 130        140        150        160        170        180

190        200        210        220        230        240
orf11ng-1.pep  SADYRIVRDHSEPEGQGYFTHSYVGPVVYTPEGNFQKVSFSDLDDDAKSGKSEAEYIRKT
               ||||||||||||||||||||||||||||||||||||||||||||||||||||||||||||
orf11-1        SADYRIVRDHSEPEGQGYFTHSYVGPVVYTPEGNFQKVSFSDLDDDAKSGKSEAEYIRKT
                 190        200        210        220        230        240

250        260        270        280        290        300
orf11ng-1.pep  PTGWLGMIEHHFMSTWILQPKGGQNVCAQGDCRIDIKRRNDKLYSASVSVPLTAIPTRGP
               ||||||||||||||||||||||:|||  |:| ||||||||||||:||||||:|  :  |
orf11-1        PTGWLGMIEHHFMSTWILQPKGRQSVCAAGECNIDIKRRNDKLYSTSVSVPLAAIQN-GA
                 250        260        270        280        290

310        320        330        340        350        360
orf11ng-1.pep  KPKMAVNLYAGPQTTSVIANIADNLQLAKDYGKVHWFASPLFWLLNQLHNIIGNWGWAIV
               |  : ::|||||||||||||||||||||||||||||||||||||||||||||||||||:
orf11-1        KAEASINLYAGPQTTSVIANIADNLQLAKDYGKVHWFASPLFWLLNQLHNIIGNWGWAII
                 300        310        320        330        340        350

370        380        390        400        410        420
orf11ng-1.pep  VLTIIVKAVLYPLTNASYRSMAKMRAAAPKLQTIKEKYGDDRMAQQQAMMQLYKDEKINP
               ||||||||||||||||||||||||||||||||:|||||||||||||||||||:|||||||
orf11-1        VLTIIVKAVLYPLTNASYRSMAKMRAAAPKLQAIKEKYGDDRMAQQQAMMQLYTDEKINP
                 360        370        380        390        400        410

430        440        450        460        470        480
orf11ng-1.pep  LGGCLPMLLQIPVFIGLYWALFASVELRQAPWLGWITDLSRADPYYILPIIMAATMFAQT
               ||||||||||||||||||||||||||||||||||||||||||||||||||||||||||||
orf11-1        LGGCLPMLLQIPVFIGLYWALFASVELRQAPWLGWITDLSRADPYYILPIIMAATMFAQT
                 420        430        440        450        460        470
```

```
                   490       500       510       520       530       540
orf11ng-1.pep  YLNPPPTDPMQAKMMKIMPLVFSVMFFFFPAGLVLYWVVNNLLTIAQQWHINRSIEKQRA
               ||||||||||||||||||||||||||||||||||||||||||||||||||||||||||||
orf11-1        YLNPPPTDPMQAKMMKIMPLVFSVMFFFFPAGLVLYWVVNNLLTIAQQWHINRSIEKQRA
               480       490       500       510       520       530 orf11ng-1.pep  QGEVVSX
               |||||||
orf11-1        QGEVVSX
               540
```

In addition, ORF11ng-1 shows significant homology with an inner-membrane protein from the database (accession number p25754):

```
ID   60IM_PSEPU    STANDARD;      PRT;   560 AA.
AC   P25754;
DT   01-MAY-1992  (REL. 22, CREATED)
DT   01-MAY-1992  (REL. 22, LAST SEQUENCE UPDATE)
DT   01-NOV-1995  (REL. 32, LAST ANNOTATION UPDATE)
DE   60 KD INNER-MEMBRANE PROTEIN. . . .

SCORES       Init1:  1074 Initn:  1293 Opt:  1103
Smith-Waterman score: 1406;     41.5% identity in 574 aa overlap 10        20              30        40
orf11ng-1.pep  MDFKR---LTAFFAIALVIMIGW-----EKMFPT------------PKPVPAPQQAAQKQ
               ||:||   ::|: ::: |:::  |      : :||         |  ||| :::|: :
p25754         MDIKRTILIAAALAVVSYVMVLKWNDDYGQAALPTQNTAASTVAPGLPDGVPAGNNGASAD
                   10        20        30        40        50        60

50              60        70        80        90
orf11ng-1.pep  AATASAEAALAPATPIT-------VTTDTVQAVIDEKSGDLRRLTLLKYKATGDE-NKPF
               : :|:||:: | :|:       | |||::: ||  :||: :|: ||    |: | ||
p25754         VPSANAESSPAELAPVALSKDLIRVKTDVLELAIDPVGGDIVQLNLPKYPRRQDHPNIPF
                  70        80        90       100       110       120

100       110       120       130       140
orf11ng-1.pep  VLFGDGKEYTYVAQSELLDAQGNNILKGIG---FSAPKKQYTL-NGD---TVEVRLSAPE
               || :|  | :|:|||  | ::| :: |    ::| :|:|  |:   :|::::|
p25754         QLFDNGGERVYLAQSGLTGTDGPDA-RASGRPLYAAEQKSYQLADGQEQLVVDLKFS---
                  130       140       150       160       170

150       160       170       180       190       200
orf11ng-1.pep  TNGLKIDKVYTFTKDSYLVNVRFDIANGSGQTANLSADYRIVRDHS-EPEGQGYF-THSY
               || :| | :|:||| | ::| ::   |    ::| :|:| |:|:   :|::::|
p25754         DNGVNYIKRFSFKRGEYDLNVSYLIDNQSGQAWNGNMFAQLKRDASGDPSSSTATGTATY
                  180       190       200       210       220       230

210       220       230       240       250       260
orf11ng-1.pep  VGPVVYTPEGNFQKVSFSDLDDDAKSGKSEAEYIRKTPTGWLGMIEHHFMSTWILQPKGG
               :|  :::|    ::|||::|:|   |: :|    ::   ||:: ::|:|::||   |:
p25754         LGAALWTASEPYKKVSMKDID---KGSLKE-----NVSGGWVAWLQHYFVTAWI-PAKSD
                  240       250       260            270       280

270       280       290       300       310       320
orf11ng-1.pep  QNVCAQGDCRIDIKRRNDKLYSASVSVPLTAIPTRGPKPKMAVNLYAGPQTTSVIANIAD
               :||     ::  :: ::   |  : :|: ::|:|  | |  :: |||||  |   |:::
p25754         NNV-------VQTRKDSQGNYIIGYTGPVISVPA-GGKVETSALLYAGPKIQSKLKELSP
                  290          300       310       320       330

330       340       350       360       370       380
orf11ng-1.pep  NLQLAKDYGKVHWF-ASPLFWLLNQLHNIIGNWGWAIVVLTIIVKAVLYPLTNASYRSMA
               :|:|: ||| : ||  |:|:|||||:::|::|||||:|||:|||::::::||  ||||||
p25754         GLELTVDYGFL-WFIAQPIFWLLQHIHSLLGNWGWSIIVLTMLIKGLFFPLSAASYRSMA
                  340       350       360       370       380       390

390       400       410       420       430       440
orf11ng-1.pep  KMRAAAPKLQTIKEKYGDDRMAQQQAMMQLYKDEKINPLGGCLPMLLQIPVFIGLYWALF
               :||||:|||  ::::|||||::|:: ::||| |||||||||||| :|:|| ::|:|||:
p25754         RMRAVAPKLAALKERFGDDRQKMSQAMMELYKKEKINPLGGCLPILVQMPVFLALYWVLL
                  400       410       420       430       440       450

450       460       470       480       490       500
orf11ng-1.pep  ASVELRQAPWLGWITDLSRADPYYILPIIMAATMFAQTYLNPPPTDPMQAKMMKIMPLVF
               |||:||||||: ||||||: ||  |||:||||:|| |||||:||| ||||||: ::||:|
p25754         ESVEMRQAPWILWITDLSIKDPFFILPIIMGATMFIQQRLNTPPPDPMQAKVMKMMPIIF
                  460       470       480       490       500       510
```

```
                            -continued
                    510        520        530        540
    orf11ng-1.pep   SVMFFFFPAGLVLYWVVNNLLTIAQQWHINRSIEKQRAQGEVVSX
                     : :| ::||||||||||||| |:|:|||:|:| ||
    p25754          TFFFLWFPAGLVLYWVVNNCLSISQQWYITRRIEAATKKAAA
                    520        530        540        550        560
```

Based on this analysis, including the homology to an inner-membrane protein from *P. putida* and the predicted transmembrane domains (seen in both the meningococcal and gonoccal proteins), it is predicted that the proteins from *N. meningitidis* and *N. gonorrhoeae*, and their epitopes, could be useful antigens for vaccines or diagnostics, or for raising antibodies.

Example 8

The following partial DNA sequence was identified in *N. meningitidis* <SEQ ID 59>:

```
    1...GCCGTCTTAA TCATCGAATT ATTGACGGGA ACGGTTTATC
        TTTTGGTTGT
   51   NAGCGCGGCT TTGGCGGGTT CGGGCATTGC TTACGGGCTG
        ACCGGCAGTA
  101   CGCCTGCCGC CGTCTTGACC GNCGCTCTGC TTTCCGCGCT
        GGGTATTTNG
  151   TTCGTACACG CCAAAACCGC CGTTAGAAAA GTTGAAACGG
        ATTCATATCA
  201   GGATTTGGAT GCCGGACAAT ATGTCGAAAT CCTCCGNCAC
        ACAGGCGGCA
  251   ACCGTTACGA AGTT.TTTAT CGCGGTACG. ACTGGCAGGC
        TCAAAATACG
  301   GGGCAAGAAG AGCTTGAACC AGGAACTCGC GCCCTCATTG
        TCCGCAAGGA
  351   AGGCAACCTT CTTATTATCA CACACCCTTA A
```

This corresponds to the amino acid sequence <SEQ ID 60; ORF13>:

```
    1...AVLIIELLTG TVYLLVVSAA LAGSGIAYGL TGSTPAAVLT
        XALLSALGIX
   51   FVHAKTAVRK VETDSYQDLD AGQYVEILRH TGGNRYEVFY
        RGTHWQAQNT
  101   GQEELEPGTR ALIVRKEGNL LIITHP*
```

Further sequence analysis elaborated the DNA sequence slightly <SEQ ID 61>:

```
    1...GCCGTCTTAA TCATCGAATT ATTGACGGGA ACGGTTTATC
        TTTTGGTTGT
   51   nAGCGCGGCT TTGGCGGGTT CGGGCATTGC TTACGGGCTG
        ACCGGCAGTA
  101   CGCCTGCCGC CGTCTTGACC GnCGCTCTGC TTTCCGCGCT
        GGGTATTTnG
  151   TTCGTACACG CCAAAACCGC CGTTAGAAAA GTTGAAACGG
        ATTCATATCA
  201   GGATTTGGAT GCCGGACAAT ATGTCGAAAT CCTCCGACAC
        ACAGGCGGCA
  251   ACCGTTACGA AGTTTTtTAT CGCGGTACGc ACTGCCAGGC
        TCAAAATACG
  301   GGGCAAGAAG AGCTTGAACC AGGAACTCGC GCCCTCATTG
        TCCGCAAGGA
  351   AGGCAACCTT CTTATTATCA CACACCCTTA A
```

This corresponds to the amino acid sequence <SEQ ID 62; ORF13-1>:

```
    1...AVLIIELLTG TVYLLVVSAA LAGSGIAYGL TGSTPAAVLT
        XALLSALGIX
   51   FVHAKTAVRK VETDSYQDLD AGQYVEILRH TGGNRYEVFY
        RGTHWQAQNT
  101   GQEELEPGTR ALIVRKEGNL LIITHP*
```

Computer analysis of this amino acid sequence gave the following results:

Homology with a Predicted ORF from *N. meningitidis* (Strain A)

ORF13 shows 92.9% identity over a 126aa overlap with an ORF (ORF13a) from strain A of *N. meningitidis*:

```
                          10         20         30         40         50
    orf13.pep     AVLIIELLTGTVYLLVVSAALAGSGIAYGLTGSTPAAVLTXALLSALGIXF
                    ||||||||||||||||||||||||||||||||||||||| ||||||||| |
    orf13a        MTVWFVAAVAVLIIELLTGTVYLLVVSAALAGSGIAYGLTGSTPAAVLTAALLSALGIWF
                          10         20         30         40         50         60

60         70         80         90        100        110
    orf13.pep     VHAKTAVRKVETDSYQDLDAGQYVEILRHTGGNRYEVXYRGTXWQAQNTGQEELEPGTRA
                    |||||||| |||||||||||||||:|||||||||||| |||| ||||||||||||||||
    orf13a        VHAKTAVGKVETDSYQDLDAGQYAEILRHAGGNRYEVFYRGTHWQAQNTGQEELEPGTRA
                          70         80         90        100        110        120
```

```
            120
orf13.pep   LIVRKEGNLLIITHPX
            ||||||||||||::||
orf13a      LIVRKEGNLLIIAKPX
            130
```

The complete length ORF13a nucleotide sequence <SEQ ID 63> is:

```
  1 ATGACTGTAT GGTTTGTTGC CGCTGTTGCC GTCTTAATCA
    TCGAATTATT

51 GACGGGAACG GTTTATCTTT TGGTTGTCAG CGCGGCTTTG
    GCGGGTTCGG

101 GCATTGCTTA CGGGCTGACC GGCAGCACGC CTGCCGCCGT
    CTTGACCGCC

151 GCTCTGCTTT CCGCGCTGGG TATTTGGTTC GTACACGCCA
    AAACCGCCGT

201 GGGAAAAGTT GAAACGGATT CATATCAGGA TTTGGATGCC
    GGGCAATATG

251 CCGAAATCCT CCGGCACGCA GGCGGCAACC GTTACGAAGT
    TTTTTATCGC

301 GGTACGCACT GGCAGGCTCA AAATACGGGG CAAGAAGAGC
    TTGAACCAGG

351 AACGCGCGCC CTAATCGTCC GCAAGGAAGG CAACCTTCTT
    ATCATCGCAA

401 AACCTTAA
```

This encodes a protein having amino acid sequence <SEQ ID 64>:

```
  1 MTVWFVAAVA VLIIELLTGT VYLLVVSAAL AGSGIAYGLT
    GSTPAAVLTA

51 ALLSALGIWF VHAKTAVGKV ETDSYQDLDA GQYAEILRHA
    GGNRYEVFYR

101 GTHWQAQNTG QEELEPGTRA LIVRKEGNLL IIAKP*
```

ORF13a and ORF13-1 show 94.4% identity in 126 aa overlap

```
                   10        20        30        40        50        60
orf13a.pep   MTVWFVAAVAVLIIELLTGTVYLLVVSAALAGSGIAYGLTGSTPAAVLTAALLSALGIWF
                       ||||||||||||||||||||||||||||||||||||||| |||||||| |
orf13-1              AVLIIELLTGTVYLLVVSAALAGSGIAYGLTGSTPAAVLTXALLSALGIXF
                           10        20        30        40        50

70        80        90       100       110       120
orf13A.pep   VHAKTAVGKVETDSYQDLDAGQYAEILRHAGGNRYEVFYRGTHWQAQNTGQEELEPGTRA
             |||||||  ||||||||||||||:|||||:||||||||||||||||||||||||||||||
orf13-1      VHAKTAVRKVETDSYQDLDAGQYVEILRHTGGNRYEVFYRGTHWQAQNTGQEELEPGTRA
                    60        70        80        90       100       110

130
orf13a.pep   LIVRKEGNLLIIAKPX
             ||||||||||||::||
orf13-1      LIVRKEGNLLIITHPX
                      120
```

Homology with a Predicted ORF from *N. gonorrhoeae*

ORF13 shows 89.7% identity over a 126aa overlap with a predicted ORF (ORF13.ng) from *N. gonorrhoeae*:

```
orf13             AVLIIELLTGTVYLLVVSAALAGSGIAYGLTGSTPAAVLTXALLSALGIXF   51
                  ||||||||||||||||||||||||||||||||||||||| |||||||| |
orf13ng   MTVWFVAAVAVLIIELLTGTVYLLVVSAALAGSGIAYGLTGSTPAAVLTAALLSALGIWF   60 orf13     VHAKTAVRKVETDSYQDLDAGQYVEILRHTGGNRYEVXYRGTXWQAQNTGQEELEPGTRA  111
          |||||||  ||||||||||||:|:||||:|||||||||  |||| |||||||||:||||||
orf13ng   VHAKTAVGKVETDSYQDLDTGKYAEILRYTGGNRYEVFYRGTHWQAQNTGQEVFEPGTRA  120 orf13     LIVRKEGNLLIITHP  126
          ||||||||||||::|
orf13ng   LIVRKEGNLLIIANP  135
```

The complete length ORF13ng nucleotide sequence <SEQ ID 65> is:

```
  1 ATGACTGTAT GGTTTGTTGC CGCTGTTGCC GTCTTAATCA
    TCGAATTATT
 51 GACGGGAACG GTTTATCTTT TGGTTGTCAG CGCGGCTTTG
    GCGGGTTCGG
101 GCATTGCCTA CGGGCTGACT GGCAGCACGC CTGCCGCCGT
    CTTGACCGCC
151 GCACTGCTTT CCGCGCTGGG CATTTGGTTC GTACATGCCA
    AAACCGCCGT
201 GGGAAAAGTT GAAACGGATT CATATCAGGA TTTGGATACC
    GGAAAATATG
251 CCGAAATCCT CCGATACACA GGCGGCAACC GTTACGAAGT
    TTTTTATCGC
301 GGTACGCACT GGCAGGCGCA AAATACGGGG CAGGAAGTGT
    TTGAACCGGG
351 AACGCGCGCC CTCATCGTCC GCAAAGAAGG TAACCTTCTT
    ATCATCGCAA
401 ACCCTTAA
```

This encodes a protein having amino acid sequence <SEQ ID 66>:

```
  1 MTVWFVAAVA VLIIELLTGT VYLLVVSAAL AGSGIAYGLT
    GSTPAAVLTA
 51 ALLSALGIWF VHAKTAVGKV ETDSYQDLDT GKYAEILRYT
    GGNRYEVFYR
101 GTHWQAQNTG QEVFEPGTRA LIVRKEGNLL IIANP*
```

ORF13ng shows 91.3% identity in 126 aa overlap with ORF13-1:

```
  1 ATGTwTGATT TCGGTTTrGG CGArCTGGTT TTTGTCGGCA
    TTATCGCCCT
 51 GATwGtCCTC GGCCCCGAAC GCsTGCCCGA GGCCGCCCGC
    AyCGCCGGAC
101 GGcTCATCGG CAGGCTGCAA CGCTTTGTCG GcAGCGTCAA
    ACAGGAATTT
151 GACACTCAAA TCGAACTGGA AGAACTGAGG AAGGCAAAGC
    AGGAATTTGA
201 AGCTGCCGcC GCTCAGGTTC GAGACAGCCT CAAAGAAACC
    GGTACGGATA
251 TGGAAGGCAA TCTGCACGAC ATTTCCGACG GTCTGAAGCC
    TTGGGAAAAA
301 CTGCCCGAAC AGCGGACACC TGCCGATTTC GGTGTCGATG
    AAAACGGCAA
351 TCCGCT.TCC CGATGCGGCA AACACCCTAT CAGACGGCAT
    TTCCGACGTT
401 ATGCCGTC..
```

This corresponds to the amino acid sequence <SEQ ID 68; ORF2>:

```
  1 MXDFGLGELV FVGIIALIVL GPERXPEAAR XAGRLIGRLQ
    RFVGSVKQEF
 51 DTQIELEELR KAKQEFEAAA AQVRDSLKET GTDMEGNLHD
    ISDGLKPWEK
101 LPEQRTPADF GVDENGNPXS RCGKHPIRRH FRRYAV..
```

Further work revealed the complete nucleotide sequence <SEQ ID 69>:

```
                   10         20         30         40         50
orf13-1.pep       AVLIIELLTGTVYLLVVSAALAGSGIAYGLTGSTPAAVLTXALLSALGIXF
                  ||||||||||||||||||||||||||||||||||||||| |||||||| |
orf13ng      MTVWFVAAVAVLIIELLTGTVYLLVVSAALAGSGIAYGLTGSTPAAVLTAALLSALGIWF
             10         20         30         40         50         60

60         70         80         90        100        110
orf13-1.pep       VHAKTAVRKVETDSYQDLDAGQYVEILRHTGGNRYEVFYRGTXWQAQNTGQEELEPGTRA
                  |||||||| |||||||||||:|:|:||||:|||||||||| ||||||||| :||||||
orf13ng           VHAKTAVGKVETDSYQDLDTGKYAEILRYTGGNRYEVFYRGTHWQAQNTGQEVFEPGTRA
                      70         80         90        100        110        120 orf13-1.pep       LIVRKEGNLLIITHPX
                  ||||||||||||::||
orf13ng           LIVRKEGNLLIIANPX
                      130
```

Based on this analysis, including the extensive leader sequence in this protein, it is predicted that ORF13 and ORF13ng are likely to be outer membrane proteins. It is thus predicted that the proteins from *N. meningitidis* and *N. gonorrhoeae*, and their epitopes, could be useful antigens for vaccines or diagnostics, or for raising antibodies.

Example 9

The following DNA sequence was identified in *N. meningitidis* <SEQ ID 67>:

```
  1 ATGTTTGATT TCGGTTTGGG CGAGCTGGTT TTTGTCGGCA
    TTATCGCCCT
 51 GATTGTCCTC GGCCCCGAAC GCCTGCCCGA GGCCGCCCGC
    ACCGCCGGAC
101 GGCTCATCGG CAGGCTGCAA CGCTTTGTCG GCAGCGTCAA
    ACAGGAATTT
151 GACACTCAAA TCGAACTGGA AGAACTGAGG AAGGCAAAGC
    AGGAATTTGA
201 AGCTGCCGCC GCTCAGGTTC GAGACAGCCT CAAAGAAACC
    GGTACGGATA
```

-continued

```
251 TGGAAGGCAA TCTGCACGAC ATTTCCGACG GTCTGAAGCC
    TTGGGAAAAA

301 CTGCCCGAAC AGCGGACACC TGCCGATTTC GGTGTCGATG
    AAAACGGCAA

351 TCCGCTTCCC GATGCGGCAA ACACCCTATC AGACGGCATT
    TCCGACGTTA

401 TGCCGTCCGA ACGTTCCTAC GCTTCCGCCG AAACCCTTGG
    GGACAGCGGG

451 CAAACCGGCA GTACAGCCGA ACCCGCGGAA ACCGACCAAG
    ACCGCGCATG

501 GCGGGAATAC CTGACTGCTT CTGCCGCCGC ACCCGTCGTA
    CAGACCGTCG

551 AAGTCAGCTA TATCGATACT GCTGTTGAAA CGCCTGTTCC
    GCACACCACT

601 TCCCTGCGCA AACAGGCAAT AAGCCGCAAA CGCGATTTTC
    GTCCGAAACA

651 CCGCGCCAAA CCTAAATTGC GCGTCCGTAA ATCATAA
```

This corresponds to the amino acid sequence <SEQ ID 70; ORF2-1>:

```
  1 MFDFGLGELV FVGIIALIVL GPERLPEAAR TAGRLIGRLQ
    RFVGSVKQEF

51 DTQIELEELR KAKQEFEAAA AQVRDSLKET GTDMEGNLHD
    ISDGLKPWEK

101 LPEQRTPADF GVDENGNPLP DAANTLSDGI SDVMPSERSY
    ASAETLGDSG

151 QTGSTAEPAE TDQDRAWREY LTASAAAPVV QTVEVSYIDT
    AVETPVPHTT

201 SLRKQAISRK RDFRPKHRAK PKLRVRKS*
```

Further work identified the corresponding gene in strain A of *N. meningitidis* <SEQ ID 71>:

```
  1 ATGTTTCATT TCCGTTTGGG CGAGCTCGTT TTTGTCCGCA
    TTATCGCCCT

51 GATTGTCCTC GGCCCCGAAC GCCTGCCCGA GGCCGCCCGC
    ACCGCCGGAC
```

-continued

```
101 GGCTCATCGG CAGGCTGCAA CGCTTTGTCG GCAGCGTCAA
    ACAGGAATTT

151 GACACGCAAA TCGAACTGGA AGAACTAAGG AAGGCAAAGC
    AGGAATTTGA

201 AGCTGCCGCT GCTCAGGTTC GAGACAGCCT CAAACAAACC
    GGTACGGATA

251 TGGAGGGTAA TCTGCACGAC ATTTCCGACG GTCTGAAGCC
    TTCGGAAAAA

301 CTGCCCGAAC AGCGCACGCC TGCTGATTTC GGTGTCGATG
    AAAACGGCAA

351 TCCCTTTCCC GATGCGGCAA ACACCCTATT AGACGGCATT
    TCCGACGTTA

401 TGCCGTCCGA ACGTTCCTAC GCTTCCGCCG AAACCCTTGG
    GGACAGCGGG

451 CAAACCGGCA GTACAGCCGA ACCCGCGGAA ACCGACCAAG
    ACCGTGCATG

501 GCGGGAATAC CTGACTGCTT CTGCCGCCGC ACCCGTCGTA
    CAGACCGTCG

551 AAGTCAGCTA TATCGATACC GCTGTTGAAA CCCCTGTTCC
    GCATACCACT

601 TCGCTGCGTA AACAGGCAAT AAGCCGCAAA CGCGATTTGC
    GTCCTAAATC

651 CCGCGCCAAA CCTAAATTGC GCGTCCGTAA ATCATAA
```

This encodes a protein having amino acid sequence <SEQ ID 72; ORF2a>:

```
  1 MFDFGLGELV FVGIIALIVL GPERLPEAAR TAGRLIGRLQ
    RFVGSVKQEF

51 DTQIELEELR KAKQEFEAAA AQVRDSLKET GTDMEGNLHD
    ISDGLKPWEK

101 LPEQRTPADF GVDENGNPFP DAANTLLDGI SDVMPSERSY
    ASAETLGDSG

151 QTGSTAEPAE TDQDRAWREY LTASAAAPVV QTVEVSYIDT
    AVETPVPHTT

201 SLRKQAISRK RDLRPKSRAK PKLRVRKS*
```

The originally-identified partial strain B sequence (ORF2) shows 97.5% identity over a 118aa overlap with ORF2a:

```
                 10         20         30         40         50         60
orf2.pep    MXDFGLGELVFVGIIALIVLGPERXPEAARXAGRLIGRLQRFVGSVKQEFDTQIELEELR
            ||||||||||||||||||||||| |||| :|||||||||||||||||||||||||||||||
orf2a       MFDFGLGELVFVGIIALIVLGPERLPEAARTAGRLIGRLQRFVGSVKQEFDTQIELEELR
                 10         20         30         40         50         60

70         80         90        100        110        120
orf2.pep    KAKQEFEAAAAQVRDSLKETGTDMEGNLHDISDGLKPWEKLPEQRTPADFGVDENGNPXS
            |||||||||||||||||||||||||||||||||||||||||||||||||||||||||||
orf2a       KAKQEFEAAAAQVRDSLKETGTDMEGNLHDISDGLKPWEKLPEQRTPADFGVDENGNPFP
                 70         80         90        100        110        120

130
orf2.pep    RCGKHPIRRHFRRYAV orf2a       DAANTLLDGISDVMPSERSYASAETLGDSGQTGSTAEPAETDQDRAWREYLTASAAAPVV
                130        140        150        160        170        180
```

The complete strain B sequence (ORF2-1) and ORF2a show 98.2% identity in 228 aa overlap:

```
orf2a.pep    MFDFGLGELVFVGIIALIVLGPERLPEAARTAGRLIGRLQRFVGSVKQEFDTQIELEELR  60
             ||||||||||||||||||||||||||||||||||||||||||||||||||||||||||||
orf2-1       MFDFGLGELVFVGIIALIVLGPERLPEAARTAGRLIGRLQRFVGSVKQEFDTQIELEELR  60 orf2a.pep    KAKQEFEAAAAQVRDSLKETGTDMEGNLHDISDGLKPWEKLPEQRTPADFGVDENGNPFP 120
             |||||||||||||||||||||||||||||||||||||||||||||||||||||||||:|
orf2-1       KAKQEFEAAAAQVRDSLKETGTDMEGNLHDISDGLKPWEKLPEQRTPADFGVDENGNPLP 120 orf2a.pep    DAANTLLDGISDVMPSERSYASAETLGDSGQTGSTAEPAETDQDRAWREYLTASAAAPVV 180
             ||||||  ||||||||||||||||||||||||||||||||||||||||||||||||||
orf2-1       DAANTLSDGISDVMPSERSYASAETLGDSGQTGSTAEPAETDQDRAWREYLTASAAAPVV 180 orf2a.pep    QTVEVSYIDTAVETPVPHTTSLRKQAISRKRDLRPKSRAKPKLPVRKSX 229
             |||||||||||||||||||||||||||||||:|||||||||||:||||
orf2-1       QTVEVSYIDTAVETPVPHTTSLRKQAISRKRDFRPKHRAKPKLRVRKSX 229
```

Further work identified a partial DNA sequence <SEQ ID 73> in *N. gonorrhoeae* encoding the following amino acid sequence <SEQ ID 74; ORF2ng>:

```
  1 MFDFGLGELI FVGIIALIVL GPERLPEAAR TAGRLIGRLQ
    RFVGSVKQEL

51 DTQIELEELR KVKQAFEAAA AQVRDSLKET DTDMQNSLHD
    ISDGLKPWEK

101 LPEQRTPADF GVDEKGNSLS RYGKHRIRRH FRRYAV*
```

Further work identified the complete gonococcal gene sequence <SEQ ID 75>:

```
  1 ATGTTTGATT TCGGTTTGGG CGAGCTGATT TTTGTCGGCA TTATCGCCCT

51 GATTGTCCTT GGTCCAGAAC GCCTGCCCGA AGCCGCCCGC ACTGCCGGAC

101 GGCTTATCGG CAGGCTGCAA CGCTTTGTAG GAAGCGTCAA ACAAGAACTT

151 GACACTCAAA TCGAACTGGA AGAGCTGAGG AAGGTCAAGC AGGCATTCGA

201 AGCTGCCGCC GCTCAGGTTC GAGACAGCCT CAAAGAAACC GATACGGATA

251 TGCAGAACAG TCTGCACGAC ATTTCCGACG GTCTGAAGCC TTGGGAAAAA

301 CTGCCCGAAC AGCGCACGCc tgccgatttc gGTGTCGATg AAAacggcaa 351 tccccttccc gATACGGCAA ACACCGTATC AGACGGCATT TCCGACGTTA 401 TGCCGTCTGA ACGTTCCGAT ACTtccgcCG AAACCCTTGG GGACGACAGG

451 CAAACCGGCA GTACAGCCGA ACCTGCGGAA ACCGACAAAG ACCGCGCATG

501 GCGGGAATAC CTGactgctt ctgccgccgc acctgtcgta Cagagggccg 551 tcgaagtcag ctaTATCGAT ACTGCTGTTG AAacgcctgT tccgcaCacc 601 acttccctgc gcaAACAGGC AATAAACCGC AAACGCGATT TttgtccgaA 651 ACACCGCGCc aAACCGAAat tgcgcgtcCG TAAATCATAA
```

This encodes a protein having the amino acid sequence <SEQ ID 76; ORF2ng-1>:

```
  1 MFDFGLGELI FVGIIALIVL GPERLPEAAR TAGRLIGRLQ RFVGSVKQEL

51 DTQIELEELR KVKQAFEAAA AQVRDSLKET DTDMQNSLHD ISDGLKPWEK

101 LPEQRTPADF GVDENGNPLP DTANTVSDGI SDVMPSERSD TSAETLGDDR
```

```
151 QTGSTAEPAE TDKDRAWREY LTASAAAPVV QRAVEVSYID TAVETPVPHT

201 TSLRKQAINR KRDFCPKHRA KPKLRVRKS*
```

The originally-identified partial strain B sequence (ORF2) shows 87.5% identity over a 136aa overlap with ORF2ng:

```
orf2.pep   MXDFGLGELVFVGIIALIVLGPERXPEAARXAGRLIGRLQRFVGSVKQEFDTQIELEELR    60
           | ||||||| :|||||||||||| ||||:|||||||||||||||||||||:|||||||||
orf2ng     MFDFGLGELIFVGIIALIVLGPERLPEAARTAGRLIGRLQRFVGSVKQELDTQIELEELR    60 orf2.pep   KAKQEFEAAAAQVRDSLKETGTDMEGNLHDISDGLKPWEKLPEQRTPADFGVDENGNPXS   120
           |:|| |||||||||||||||| |||:::||||||||||||||||||||||||||||:||
orf2ng     KVKQAFEAAAAQVRDSLKETDTDMQNSLHDISDGLKPWEKLPEQRTPADFGVDEKGNSLP   120 orf2.pep   RCGKHPIRRHFRRYAV                                              136
           | ||| ||||||||||
orf2ng     RYGKHRIRRHFRRYAV                                              136
```

The complete strain B and gonococcal sequences (ORF2-1 & ORF2ng-1) show 91.7% identity in 229 aa overlap:

```
                    10         20         30         40         50         60
orf2-1.pep  MFDFGLGELVFVGIIALIVLGPERLPEAARTAGRLIGRLQRFVGSVKQEFDTQIELEELR
            ||||||||| :|||||||||||||||||||||||||||||||||||||:|||||||||||
orf2ng-1    MFDFGLGELIFVGIIALIVLGPERLPEAARTAGRLIGRLQRFVGSVKQELDTQIELEELR
                    10         20         30         40         50         60

70         80         90        100        110        120
orf2-1.pep  KAKQEFEAAAAQVRDSLKETGTDMEGNLHDISDGLKPWEKLPEQRTPADFGVDENGNPLP
            |:|| ||||||||||||||| |||:::||||||||||||||||||||||||||||||||
orf2ng-1    KVKQAFEAAAAQVRDSLKETDTDMQNSLHDISDGLKPWEKLPEQRTPADFGVDENGNPLP
                    70         80         90        100        110        120

130        140        150        160        170        180
orf2-1.pep  DAANTLSDGISDVMPSERSYASAETLGDSGQTGSTAEPAETDQDRAWREYLTASAAAPVV
            |:||| ||||||||||||||   :|||||| : ||||||||||||||||||||||||||
orf2ng-1    DTANTVSDGISDVMPSERSDTSAETLGDDRQTGSTAEPAETDKDRAWREYLTASAAAPVV
                   130        140        150        160        170        180

190        200        210        220   229
orf2-1.pep  Q-TVEVSYIDTAVETPVPHTTSLRKQAISRKRDFRPKHRAKPKLRVRKSX
            | :|||||||||||||||||||||||||| |||||| |||||||||||||
orf2ng-1    QRAVEVSYIDTAVETPVPHTTSLRKQAINRKRDFCPKHRAKPKLRVRKSX
                   190        200        210        220        230
```

Computer analysis of these amino acid sequences indicates a transmembrane region (underlined), and also revealed homology (59% identity) between the gonococcal sequence and the TatB protein of E. coli:

```
gnl|PID|e1292181 (AJ005830) TatB protein [Escherichia coli] Length = 171
Score = 56.6 bits (134), Expect = 1e-07
Identities = 30/88 (34%), Positives = 52/88 (59%), Gaps = 1/88 (1%)

Query:  1  MFDFGLGELIFVGIIALIVLGPERLPEAARTAGRLIGRLQRFVGSVKQELDTQIELEELR   60
           MFD   EL+ V II L+VLGP+RLP A +T    I  L+    +V+ EL  +++L+E  +
Sbjct:  1  MFDIGFSELLLVFIIGLVVGPQRLPVAVKTVAGWIRALRSLATTVQNELTQELKLQEFQ   60

Query: 61  -KVKQAFEAAAAQVRDSLKETDTDMQNS                                   87
            +K+  +A+   +  LK +  +++ +
Sbjct: 61  DSLKKVEKASLTNLTPELKASMDELRQA                                   88
```

Based on this analysis, it was predicted that ORF2, ORF2a and ORF2ng are likely to be membrane proteins and so the proteins from N. meningitidis and N. gonorrhoeae, and their epitopes, could be useful antigens for vaccines or diagnostics, or for raising antibodies.

ORF2-1 (16 kDa) was cloned in pET and pGex vectors and expressed in E. coli, as described above. The products of protein expression and purification were analyzed by SDS-PAGE. FIG. 3A shows the results of affinity purification of the GST-fusion protein, and FIG. 3B shows the results of expression of the His-fusion in E. coli. Purified GST-fusion protein was used to immunise mice, whose sera were used for Western blots (FIG. 3C), ELISA (positive result), and FACS analysis (FIG. 3D). These experiments confirm that ORF37-1 is a surface-exposed protein, and that it is a useful immunogen.

Example 10

The following partial DNA sequence was identified in *N. meningitidis* <SEQ ID 77>:

```
  1 ATGCAAGCAC GGCTGCTGAT ACCTATTCTT TTTTCAGTTT TTATTTTATC
 51 CGC.TGCGGG ACACTGACAG GTATTCCATC GCATGGCGgA GkTAAACgCT
101 TTgCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGcAGTTT GACAGGGGGG TCGCTACTCC
251 ATTGATGCAC kGrTwCsTGG CGAATACATA AACAGCCCTG CCGTCCGTAC
301 CGATTACACC TATCCACGTT ACGAAACCAC CGCTGAAACA ACATCAGGCG
351 GTTTGACAGG TTTAACCACT TCTTTATCTA CACTTAATGC CCCTGCACTC
401 TCTCGCACCC AATCAGACGG TAGCGGAAGT AAAAGCAGTC TGGGCTTAAA
451 TATTGGCGGG ATGGGGGATT ATCGAAATGA AACCTTGACG ACTAACCCGC
501 GCGACACTGC CTTTCTTTCC CACTTGGTAC AGACCGTATT TTTCCTGCGC
551 GGCATAGACG TTGTTTCTCC TGCCAATGCC GATACAGATG TGTTTATTAA
601 CATCGACGTA TTCGGAACGA TACGCAACAG AACCGAAATG..
```

This corresponds to the amino acid sequence <SEQ ID 78; ORF15>:

```
  1 MQARLLIPIL FSVFILSACG TLTGTPSHGG XKRFAVEQEL VAASARAAVK
 51 DMDLQALHGR KVALYIATMG DQGSGSLTGG RYSIDAXXXG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEM..
```

Further work revealed the complete nucleotide sequence <SEQ ID 79>:

```
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TTGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CTCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACCT TGTTTCTCCT GCCAATGCCG ATACAGATGT GTTTATTAAC
```

```
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGGCCGTATA AAGTAAGCAA
801 AGGAATTAAA CCGACGGAAG GATTAATGGT CGATTTCTCC GATATCCGAC
851 CATACGGCAA TCATACGGGT AACTCCGCCC CATCCGTAGA GGCTGATAAC
901 AGTCATGAGG GGTATGGATA CAGCGATGAA GTAGTGCGAC AACATAGACA
951 AGGACAACCT TGA
```

This corresponds to the amino acid sequence <SEQ ID 80; ORF15-1>:

```
  1 MQARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEMHLYNAET LKAQTKLEYF AVDRTNKKLL IKPKTNAFEA
251 AYKENYALWM GPYKVSKGIK PTEGLMVDFS DIRPYGNHTG NSAPSVEADN
301 SHEGYGYSDE VVRQHRQGQP *
```

Further work identified the corresponding gene in strain A of *N. meningitidis* <SEQ ID 81>:

```
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TTGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 AACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CGCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACGGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGACCGTATA AAGTAAGCAA
801 AGGAATTAAA CCGACAGAAG GATTAATGGT CGATTTCTCC GATATCCAAC
851 CATACGGCAA TCATATGGGT AACTCTGCCC CATCCGTAGA GGCTGATAAC
```

```
901 AGTCATGAGG GGTATGGATA CAGCGATGAA GCAGTGCGAC GACATAGACA

951 AGGGCAACCT TGA
```

This encodes a protein having amino acid sequence <SEQ ID 82; ORF15a>:

```
  1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHMG NSAPSVEADN

301 SHEGYGYSDE AVRRHRQGQP *
```

The originally-identified partial strain B sequence (ORF15) shows 98.1% identity over a 213aa overlap with ORF15a:

```
                        10         20         30         40         50         60
   orf15.pep  MQARLLIPILFSVFILSACGTLTGIPSHGGXKRFAVEQELVAASARAAVKDMDLQALHGR
              |||||||||||||||||||||||||||||| |||||||||||||||||||||||||||||
   orf15a     MQARLLIPILFSVFILSACGTLTGIPSHGGGKRFAVEQELVAASARAAVKDMDLQALHGR
                        10         20         30         40         50         60

70         80         90        100        110        120
   orf15.pep  KVALYIATMGDQGSGSLTGGRYSIDAXXXGEYINSPAVRTDYTYPRYETTAETTSGGLTG
              ||||||||||||||||||||||||||   |||||||||||||||||||||||||||||||
   orf15a     KVALYIATMGDQGSGSLTGGRYSIDALIRGEYINSPAVRTDYTYPRYETTAETTSGGLTG
                        70         80         90        100        110        120

130        140        150        160        170        180
   orf15.pep  LTTSLSTLNAPALSRTQSDGSGSKSSLGLNIGGMGDYRNETLTTNPRDTAFLSHLVQTVF
              ||||||||||||||||||||||||||||||||||||||||||||||||||||||||||||
   orf15a     LTTSLSTLNAPALSRTQSDGSGSKSSLGLNIGGMGDYRNETLTTNPRDTAFLSHLVQTVF
                       130        140        150        160        170        180

190        200        210
   orf15.pep  FLRGIDVVSPANADTDVFINIDVFGTIRNRTEM
              |||||||||||||||||||||||||||||||||
   orf15a     FLRGIDVVSPANADTDVFINIDVFGTIRNRTEMHLYNAETLKAQTKLEYFAVDRTNKKLL
                       190        200        210        220        230        240
```

This complete strain B sequence (ORF15-1) and ORF15a show a 98.8% identity in 320 aa overlap:

```
                         10         20         30         40         50         60
   orf15a.pep  MQARLLIPILFSVFILSACGTLTGIPSHGGGKRFAVEQELVAASARAAVKDMDLQALHGR
               ||||||||||||||||||||||||||||||||||||||||||||||||||||||||||||
   orf15-1     MQARLLIPILFSVFILSACGTLTGIPSHGGGKRFAVEQELVAASARAAVKDMDLQALHGR
                         10         20         30         40         50         60

70         80         90        100        110        120
   orf15a.pep  KVALYIATMGDQGSGSLTGGRYSIDALIRGEYINSPAVRTDYTYPRYETTAETTSGGLTG
               ||||||||||||||||||||||||||||||||||||||||||||||||||||||||||||
   orf15-1     KVALYIATMGDQGSGSLTGGRYSIDALIRGEYINSPAVRTDYTYPRYETTAETTSGGLTG
                         70         80         90        100        110        120

130        140        150        160        170        180
   orf15a.pep  LTTSLSTLNAPALSRTQSDGSGSKSSLGLNIGGMGDYRNETLTTNPRDTAFLSHLVQTVF
               ||||||||||||||||||||||||||||||||||||||||||||||||||||||||||||
   orf15-1     LTTSLSTLNAPALSRTQSDGSGSKSSLGLNIGGMGDYRNETLTTNPRDTAFLSHLVQTVF
                        130        140        150        160        170        180
```

```
                    190        200        210        220        230        240
orf15a.pep  FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
orf15-1     FLRGIDVVSPANADTDVFINIDVFGTIRNRTEMHLYNAETLKAQTKLEYFAVDRTNKKLL
                    190        200        210        220        230        240
                    250        260        270        280        290        300
orf15a.pep  IKPKTNAFEAAYKENYALWMGPYKVSKGIKPTEGLMVDFSDIQPYGNHMGNSAPSVEADN
            |||||||||||||||||||||||||||||||||||||||||:||||  ||||||||||||
orf15-1     IKPKTNAFEAAYKENYALWMGPYKVSKGIKPTEGLMVDFSDIRPYGNHTGNSAPSVEADN
                    250        260        270        280        290        300
                    310        320
orf15a.pep  SHEGYGYSDEAVRRHRQGQPX
            ||||||||||:||:|||||||
orf15-1     SHEGYGYSDEVVRQHRQGQPX
                    310        320
```

Further work identified the corresponding gene in *N. gonorrhoeae* <SEQ ID 83>:

```
  1 ATGCGGGCAC GGCTGCTGAT ACCTATTCTT TTTTCAGTTT TTATTTTATC
 51 CGCCTGCGGG ACACTGACAG GTATTCCATC GCATGGCCGA GGCAAACGCT
101 TCGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 AACTATGGGC GACCAAGGTT CAGGCAGTTT GACAGGGGGT CGCTACTCCA
251 TTGATGCACT GATTCGCGGC GAATACATAA ACAGCCCTGC CGTCCGCACC
301 GATTACACCT ATCCGCGTTA CGAAACCACC GCTGAAACAA CATCAGGCGG
351 TTTGACGGGT TTAACCACTT CTTTATCTAC ACTTAATGCC CCTGCACTCT
401 CGCGCACCCA ATCAGACGGT AGCGGAAGTA GGAGCAGTCT GGGCTTAAAT
451 ATTGGCGGGA TGGGGGATTA TCGAAATGAA ACCTTGACGA CCAACCCGCG
501 CGACACTGCC TTTCTTTCCC ACTTGGTGCA GACCGTATTT TTCCTGCGCG
551 GCATAGACGT TGTTTCTCCT GCCAATGCCG ATACAGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCCA AAACCAATGC GTTTGAAGCT
751 GCCTATAAAG AAAATTACGC ATTGTGGATG GGGCCGTATA AAGTAAGCAA
801 AGGAATCAAA CCGACGGAAG GATTGATGGT CGATTTCTCC GATATCCAAC
851 CATACGGCAA TCATACGGGT AACTCCGCCC CATCCGTAGA GGCTGATAAC
901 AGTCATGAGG GGTATGGATA CAGCGATGAA GCAGTGCGAC AACATAGACA
951 AGGGCAACCT TGA
```

This encodes a protein having amino acid sequence <SEQ ID 84; ORF15ng>:

```
  1 MRARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSRSSLGLN
151 IGGMGDYRNE TLTTNPRDTA FLSHLVQTVF FLRGIDVVSP ANADTDVFIN
```

```
-continued
201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

The originally-identified partial strain B sequence (ORF 15) shows 97.2% identity over a 213aa overlap with ORF15ng:

```
orf15.pep    MQARLLIPILFSVFILSACGTLTGIPSHGGXKRFAVEQELVAASARAAVKDMDLQALHGR    60
             |:|||||||||||||||||||||||||||  ||||||||||||||||||||||||||||
orf15ng      MRARLLIPILFSVFILSACGTLTGIPSHGGGKRFAVEQELVAASARAAVKDMDLQALHGR    60
orf15.pep    KVALYIATMGDQGSGSLTGGRYSIDAXXXGEYINSPAVRTDYTYPRYETTAETTSGGLTG   120
             |||||||||||||||||||||||||||   |||||||||||||||||||||||||||||
orf15ng      KVALYIATMGDQGSGSLTGGRYSIDALIRGEYINSPAVRTDYTYPRYETTAETTSGGLTG   120
orf15.pep    LTTSLSTLNAPALSRTQSDGSGSKSSLGLNIGGMGDYRNETLTTNPRDTAFLSHLVQTVF   180
             ||||||||||||||||||||||| :|||||||||||||||||||||||||||||||||||
orf15ng      LTTSLSTLNAPALSRTQSDGSGSRSSLGLNIGGMGDYRNETLTTNPRDTAFLSHLVQTVF   180
orf15.pep    FLRGIDVVSPANADTDVFINIDVFGTIRNRTEM                             213
             |||||||||||||||||||||||||||||||||
orf15ng      FLRGIDVVSPANADTDVFINIDVFGTIRNRTEMHLYNAETLKAQTKLEYFAVDRTNKKLL   240
```

The complete strain B sequence (ORF15-1) and ORF15ng show 98.8% identity in 320 aa overlap:

```
                      10         20         30         40         50         60
orf15-1.pep   MQARLLIPILFSVFILSACGTLTGIPSHGGGKRFAVEQELVAASARAAVKDMDLQALHGR
              |:||||||||||||||||||||||||||||||||||||||||||||||||||||||||||
orf15ng       MRARLLIPILFSVFILSACGTLTGIPSHGGGKRFAVEQELVAASARAAVKDMDLQALHGR
                      10         20         30         40         50         60
                      70         80         90        100        110        120
orf15-1.pep   KVALYIATMGDQGSGSLTGGRYSIDALIRGEYINSPAVRTDYTYPRYETTAETTSGGLTG
              ||||||||||||||||||||||||||||||||||||||||||||||||||||||||||||
orf15ng       KVALYIATMGDQGSGSLTGGRYSIDALIRGEYINSPAVRTDYTYPRYETTAETTSGGLTG
                      70         80         90        100        110        120
                     130        140        150        160        170        180
orf15-1.pep   LTTSLSTLNAPALSRTQSDGSGSKSSLGLNIGGMGDYRNETLTTNPRDTAFLSHLVQTVF
              |||||||||||||||||||||||:||||||||||||||||||||||||||||||||||||
orf15ng       LTTSLSTLNAPALSRTQSDGSGSRSSLGLNIGGMGDYRNETLTTNPRDTAFLSHLVQTVF
                     130        140        150        160        170        180
                     190        200        210        220        230        240
orf15-1.pep   FLRGIDVVSPANADTDVFINIDVFGTIRNRTEMHLYNAETLKAQTKLEYFAVDRTNKKLL
              ||||||||||||||||||||||||||||||||||||||||||||||||||||||||||||
orf15ng       FLRGIDVVSPANADTDVFINIDVFGTIRNRTEMHLYNAETLKAQTKLEYFAVDRTNKKLL
                     190        200        210        220        230        240
                     250        260        270        280        290        300
orf15-1.pep   IKPKTNAFEAAYKENYALWMGPYKVSKGIKPTEGLMVDFSDIRPYGNHTGNSAPSVEADN
              |||||||||||||||||||||||||||||||||||||||||:||||||||||||||||||
orf15ng       IKPKTNAFEAAYKENYALWMGPYKVSKGIKPTEGLMVDFSDIQPYGNHTGNSAPSVEADN
                     250        260        270        280        290        300
                     310        320
orf15-1.pep   SHEGYGYSDEVVRQHRQGQPX
              ||||||||||:||||||||||
orf15ng       SHEGYGYSDEAVRQHRQGQPX
                     310        320
```

Computer analysis of these amino acid sequences reveals an ILSAC motif (putative membrane lipoprotein lipid attachment site, as predicted by the MOTIFS program).

indicates a putative leader sequence, and it was predicted that the proteins from *N. meningitidis* and *N. gonorrhoeae*, and their epitopes, could be useful antigens for vaccines or diagnostics, or for raising antibodies.

ORF15-1 (31.7 kDa) was cloned in pET and pgex vectors and expressed in *E. coli*, as described above. The products of protein expression and purification were analyzed by SDS-PAGE. FIG. 4A shows the results of affinity purification of the GST-fusion protein, and FIG. 4B shows the results of expression of the His-fusion in *E. coli*. Purified GST-fusion protein was used to immunise mice, whose sera were used for Western blot (FIG. 4C) and ELISA (positive result). These experiments confirm that ORFX-1 is a surface-exposed protein, and that it is a useful immunogen.

Example 11

The following partial DNA sequence was identified in *N. meningitidis* <SEQ ID 85>:

```
  1 ...GG.CAGCACA AAAAACAGGC GGTTGAACGG AAAAACCGTA
       TTTACGATGA

51    TGCCGGGTAT GATATTCGGC GTATTCACGG GCGCATTCTC
       CGCAAAATAT

101    ATCCCCGCGT TCGGGCTTCA AATTTTCTTC ATCCTGTTTT
       TAACCGCCGT

151    CGCATTCAAA ACACTGCATA CCGACCCTCA GACGGCATCC
       CGCCCGCTGC

201    CCGGACTGCC CrGACTGACT GCGGTTTCCA CACTGTTCGG
       CACAATGTCG

251    AGCTGGGTCG GCATAGGCGG CGGTTCACTT TCCGTCCCCT
       TCTTAATCCA

301    CTGCGGCTTC CCCGCCCATA AAGCCATCGG CACATCATCC
       GGCCTTGCCT

351    GGCCGATTGC ACTCTCCGGC GCAATATCGT ATCTGCTCAA
       CGGCCTGAAT

401    ATTGCAGGAT TGCCCGAAGG GTCACTGGGC TTCCTTTACC
       TGCCCGCCGT

451    CGCCGTCCTC AGCGCGGCAA CCATTGCCTT TGCCCCGCTC
       GGTGTCAAAA

501    CCGCCCACAA ACTTTCTTCT GCCAAACTCA AAAAATC.TT
       CGGCATTATG

551    TTGCTTTTGA TTGCCGGAAA AATGCTGTAC AACCTGCTTT
       AA
```

This corresponds to the amino acid sequence <SEQ ID 86; ORF17>:

```
  1 ...GQHKKQAVNG KTVFTMMPGM IFGVFTGAFS AKYIPAFGLQ
       IFFILFLTAV

51    AFKTLHTDPQ TASRPLPGLP XLTAVSTLFG TMSSWVGIGG
       GSLSVPFLIH

101    CGFPAHKAIG TSSGLAWPIA LSGAISYLLN GLNIAGLPEG
       SLGFLYLFAV

151    AVLSAATIAF APLGVKTAHK LSSAKLKKSF GIMLLLIAGK
       MLYNLL*
```

Further work revealed the complete nucleotide sequence <SEQ ID 87>:

```
  1 ATGTGGCATT GGGACATTAT CTTAATCCTG CTTGCCCTAG
    GCAGTGCGGC

51 AGGTTTTATT GCCGGCCTGT TCGGCGTAGG CGGCGGCACG
    CTGATTGTCC

101 CTGTCGTTTT ATGGGTGCTT GATTTGCAGG GTTTGGCACA
    ACATCCTTAC

151 GCGCAACACC TCGCCGTCGG CACATCCTTC GCCGTCATGG
    TCTTCACCGC

201 CTTTTCCAGT ATGCTGGGGC AGCACAAAAA ACAGGCGGTC
    GACTGGAAAA

251 CCGTATTTAC GATGATGCCG GGTATGATAT TCGGCGTATT
    CACGGGCCCA

301 CTCTCCGCAA AATATATCCC CGCGTTCGGG CTTCAAATTT
    TCTTCATCCT

351 GTTTTTAACC GCCGTCGCAT TCAAAACACT GCATACCGAC
    CCTCAGACGG

401 CATCCCGCCC GCTGCCCGGA CTGCCCGGAC TGACTGCGGT
    TTCCACACTG

451 TTCGGCACAA TGTCGAGCTG GGTCGGCATA GGCGGCGGTT
    CACTTTCCGT

501 CCCCTTCTTA ATCCACTGCG GCTTCCCCGC CCATAAAGCC
    ATCGGCACAT

551 CATCCGGCCT TGCCTGGCCG ATTGCACTCT CCGGCGCAAT
    ATCGTATCTG

601 CTCAACGGCC TGAATATTGC AGGATTGCCC GAAGGGTCAC
    TGGGCTTCCT

651 TTACCTGCCC GCCGTCGCCG TCCTCAGCGC GGCAACCATT
    GCCTTTGCCC

701 CGCTCGGTGT CAAAACCGCC CACAAACTTT CTTCTGCCAA
    ACTCAAAAAA

751 Tc.TTCGGCA TTATGTTGCT TTTGATTGCC GGAAAAATGC
    TGTACAACCT

801 GCTTTAA
```

This corresponds to the amino acid sequence <SEQ ID 88; ORF17-1>:

```
  1 MWHWDIILIL LAVGSAAGFI AGLFGVGGGT LIVPVVLWVL
    DLQGLAQHPY

51 AQHLAVGTSF AVMVFTAFSS MLGQHKKQAV DWKTVFTMMP
    GMIFGVFTGA

101 LSAKYIPAFG LQIFFILFLT AVAFKTLHTD PQTASRPLPG
    LPGLTAVSTL

151 FGTMSSWVGI GGGSLSVPFL IHCGFPAHKA IGTSSGLAWP
    IALSGAISYL

201 LNGLNIAGLP EGSLGFLYLP AVAVLSAATI AFAPLGVKTA
    HKLSSAKLKK

251 XFGIMLLLIA GKMLYNLL*
```

Computer analysis of this amino acid sequence gave the following results:

Homology with Hypothetical *H. influenzae* Transmembrane Protein HI0902 (Accession Number P44070)

ORF17 and HI0902 proteins show 28% aa identity in 192 aa overlap:

```
ORF17    3 HKKQAVNGKTVFTMMPGMIFGVFT-GAFSAKYIPAFGLQIF--FILFLTAVAFKTLHTDP   59
           HK  +  + V  + P ++  VF  G F  +      +IF   +++L       ++  D
HI0902  72 HKLGNIVWQAVRILAPVIMLSVFICGLFIGRLDREISAKIFACLVVYLATKMVLSIKKD-  130

ORF17   60 QTASRPLPGLPXLTAVSTLFGTMSSWVGIGGGSLSVPFLIHCGFPAHKAIGTSSGLAWPI  119
           Q  ++L   L  +      L G SS GIGGG    VPFL   G   +AIG+S+     +
HI0902 131 QVTTKSLTPLSSVIG-GILIGMASSAAGIGGGGFIVPFLTARGINIKQAIGSSAFCGMLL  189

ORF17  120 ALSGAISYLLNGLNIAGLPEGSLGFLYLPAVAVLSAATIAFAPLGVXXXXXXXXXXXXXX  179
           +SG  S++++G          +PE SLG++YLPAV  ++A  +   + LG
HI0902 190 GISGMFSFIVSGWGNPLMPEYSLGYIYLPAVLGITATSFFTSKLGASATAKLPVSTLKKG  249

ORF17  180 FGIMLLLIAGKM                                                 191
           F + L+++A  M
HI0902 250 FALFLIVVAINM                                                 261
```

Homology with a Predicted ORF from *N. meningitidis* (Strain A)

ORF17 shows 96.9% identity over a 196aa overlap with an ORF (ORF17a) from strain A of *N. meningitidis*:

```
                                            10        20        30
    orf17.pep                           GQHKKQAVNGKTVFTMMPGMIFGVFTGAFS
                                        ||||||||: ||||||||||:||| :||:|
    orf17a    QGLAQHPYAQHLAVGTSFAVMVFTAFSSMLGQHKKQAVDWKTVFTMMPGMVFGVFAGALS
              50        60        70        80        90       100
                       40        50        60        70        80        90
    orf17.pep AKYIPAFGLQIFFILFLTAVAFKTLHTDPQTASRPLPGLPXLTAVSTLFGTMSSWVGIGG
              ||||||||||||||||||||||||||||||||||||||||  ||||||||||||||||||
    orf17a    AKYIPAFGLQIFFILFLTAVAFKTLHTDPQTASRPLPGLPGLTAVSTLFGTMSSWVGIGG
              110       120       130       140       150       160
                      100       110       120       130       140       150
    orf17.pep GSLSVPFLIHCGFPAHKAIGTSSGLAWPIALSGAISYLLNGLNIAGLPEGSLGFLYLPAV
              ||||||||||||||||||||||||||||||||||||||||||||||||||||||||||||
    orf17a    GSLSVPFLIHCGFPAHKAIGTSSGLAWPIALSGAISYLLNGLNIAGLPEGSLGFLYLPAV
              170       180       190       200       210       220
                      160       170       180       190
    orf17.pep AVLSAATIAFAPLGVKTAHKLSSAKLKKSFGIMLLLIAGKMLYNLLX
              |||||||||||||||||||||||||||||||||||||||||||||||
    orf17a    AVLSAATIAFAPLGVKTAHKLSSAKLKKSFGIMLLLIAGKMLYNLLX
              230       240       250       260
```

The complete length ORF17a nucleotide sequence <SEQ ID 89> is:

```
  1 ATGTGGCATT GGGACATTAT CTTAATCCTG CTTGCCGTAG
    GCAGTGCGGC
 51 AGGTTTTATT GCCGGCCTGT TCGGCGTAGG CGGCGGCACG
    CTGATTGTCC
101 CTGTCGTTTT ATGGGTGCTT GATTTGCAGG GTTTGGCACA
    ACATCCTTAC
151 GCGCAACACC TCGCCGTCGG CACATCCTTC GCCGTCATGG
    TCTTCACCGC
201 CTTTTCCAGT ATGCTGGGGC AGCACAAAAA ACAGGCGGTC
    GACTGGAAAA
251 CCGTATTTAC GATGATGCCG GGTATGGTAT TCGGCGTATT
    CGCTGGCGCA
301 CTCTCCGCAA AATATATCCC AGCGTTCGGG CTTCAAATTT
    TCTTCATCCT
351 GTTTTTAACC GCCGTCGCAT TCAAAACACT GCATACCGAC
    CCTCAGACGG
401 CATCCCGCCC GCTGCCCGGA CTGCCCGGAC TGACTGCGGT
    TTCCACACTG
451 TTCGGCACAA TGTCGAGCTG GGTCGGCATA GGCGGCGGTT
    CACTTTCCGT
501 CCCCTTCTTA ATCCACTGCG GCTTCCCCGC CCATAAAGCC
    ATCGGCACAT
551 CATCCGGCCT TGCCTGGCCG ATTGCACTCT CCGGCGCAAT
    ATCGTATCTG
601 CTCAACGGCC TGAATATTGC AGGATTGCCC GAAGGGTCAC
    TGGGCTTCCT
651 TTACCTGCCC GCCGTCGCCC TCCTCAGCGC GGCAACCATT
    GCCTTTGCCC
701 CGCTCGGTGT CAAAACCGCC CACAAACTTT CTTCTGCCAA
    ACTCAAAAAA
```

```
-continued
751 TCCTTCGGCA TTATGTTGCT TTTGATTGCC GGAAAAATGC
    TGTACAACCT

801 GCTTTAA
```

This encodes a protein having amino acid sequence <SEQ ID 90>:

```
  1 MWHWDIILIL LAVGSAAGFI AGLFGVGGGT LIVPVVLWVL
    DLQGLAQHPY
 51 AQHLAVGTSF AVMVFTAFSS MLGQHKKQAV DWKTVFTMMP
    GMVFGVFAGA
101 LSAKYIPAFG LQIFFILFLT AVAFKTLHTD PQTASRPLPG
    LPGLTAVSTL
151 FGTMSSWVGI GGGSLSVPFL IHCGFPAHKA IGTSSGLAWP
    IALSGAISYL
201 LNGLNIAGLP EGSLGFLYLP AVAVLSAATI AFAPLGVKTA
    HKLSSAKLKK
251 SFGIMLLLIA GKMLYNLL*
```

ORF17a and ORF17-1 show 98.9% identity in 268 aa overlap:

```
                         10         20         30         40         50         60
orf17a.pep   MWHWDIILILLAVGSAAGFIAGLFGVGGGTLIVPVVLWVLDLQGLAQHPYAQHLAVGTSF
             ||||||||||||||||||||||||||||||||||||||||||||||||||||||||||||
orf17-1      MWHWDIILILLAVGSAAGFIAGLFGVGGGTLIVPVVLWVLDLQGLAQHPYAQHLAVGTSF
                      10         20         30         40         50         60

70         80         90        100        110        120
orf17a.pep   AVMVFTAFSSMLGQHKKQAVDWKTVFTMMPGMVFGVFAGALSAKYIPAFGLQIFFILFLT
             |||||||||||||||||||||||||||||||||:||||:|||||||||||||||||||||
orf17-1      AVMVFTAFSSMLGQHKKQAVDWKTVFTMMPGMIFGVFTGALSAKYIPAFGLQIFFILFLT
                      70         80         90        100        110        120

130        140        150        160        170        180
orf17a.pep   AVAFKTLHTDPQTASRPLPGLPGLTAVSTLFGTMSSWVGIGGGSLSVPFLIHCGFPAHKA
             ||||||||||||||||||||||||||||||||||||||||||||||||||||||||||||
orf17-1      AVAFKTLHTDPQTASRPLPGLPGLTAVSTLFGTMSSWVGIGGGSLSVPFLIHCGFPAHKA
                      130        140        150        160        170        180

190        200        210        220        230        240
orf17a.pep   IGTSSGLAWPIALSGAISYLLNGLNIAGLPEGSLGFLYLPAVAVLSAATIAFAPLGVKTA
             ||||||||||||||||||||||||||||||||||||||||||||||||||||||||||||
orf17-1      IGTSSGLAWPIALSGAISYLLNGLNIAGLPEGSLGFLYLPAVAVLSAATIAFAPLGVKTA
                      190        200        210        220        230        240

250        260   269
orf17a.pep   HKLSSAKLKKSFGIMLLLIAGKMLYNLLX
             |||||||||| ||||||||||||||||||
orf17-1      HKLSSAKLKKXFGIMLLLIAGKMLYNLL
                      250        260
```

Homology with a Predicted ORF from *N. gonorrhoeae*

ORF17 shows 93.9% identity over a 196aa overlap with a predicted ORF (ORF17.ng) from *N. gonorrhoeae*:

```
orf17.pep                          GQHKKQAVNGKTVFTMMPGMIFGVFTGAFS    30
                                   ||||||||:||:|:||||||||||||:||:|
orf17ng    QGLAQHPYAQHLAVGTSFAVMVFTAFSSMLGQHKKQAVDWKTIFAMMPGMIFGVFAGALS   102
orf17.pep  AKYIPAFGLQIFFILFLTAVAFKTLHTDPQTASRPLPGPXLTAVSTLFGTMSSWVGIGG    90
           |||||||||||||||||||||||||||||  |||||||||||||||||||:||||||||
orf17ng    AKYIPAFGLQIFFILFLTAVAFKTLHTGRQTASRPLPGLPGLTAVSTLFGAMSSWVGIGG   162
orf17.pep  GSLSVPFLIHCGFPAHKAIGTSSGLAWPIALSGAISYLLNGLNIAGLPEGSLGFLYLPAV   150
           ||||||||||||||||||||||||||||||||||||||:|||||||||||||||||||||
orf17ng    GSLSVPFLIHCGFPAHKAIGTSSGLAWPIALSGAISYLVNGLNIAGLPEGSLGFLYLPAV   202
orf17.pep  AVLSAATIAFAPLGVKTAHKLSSAKLKKSFGIMLLLIAGKMLYNLL   196
           ||||||||||||||||||||||||||||||||||||||||||||||
orf17ng    AVLSAATIAFAPLGVKTAHKLSSAKLKKSFGIMLLLIAGKMLYNLL   268
```

An ORF17ng nucleotide sequence <SEQ ID 91> is predicted to encode a protein having amino acid sequence <SEQ ID 92>:

```
  1 MWHWDIILIL LAVGSAAGFI AGLFGVGGGT LIVPVVLWVL
    DLQGLAQHPY
 51 AQHLAVGTSF AVMVFTAFSS MLGQHKKQAV DWKTIFAMMP
    GMIFGVFAGA
101 LSAKYIPAFG LQIFFILFLT AVAFKTLHTG RQTASRPLPG
    LPGLTAVSTL
151 FGAMSSWVGI GGGSLSVPFL IHCGFPAHKA IGTSSGLAWP
    IALSGAISYL
201 VNGLNIAGLP EGSLGFLYLP AVAVLSAATI AFAPLGVKTA
    HKLSSAKLKE
251 SFGIMLLLIA GKMLYNLL*
```

Further work revealed the complete gonococcal DNA sequence <SEQ ID 93>:

```
  1 ATGTGGCATT GGGACATTAT CTTAATCCTG CTTGCcgtag
    gcAGTGCGGC
 51 AGGTTTTATT GCCGGCCTGT Tcggtgtagg cggcgGTACG
    CTGATTGTCC
101 CTGTCGTTTT ATGGGTGCTT GATTTGCAGG GTTTGGCACA
    ACATCCTTAC
151 GCGCAACACC TCGCCGTCGG CAcaTccttc gcCGTCATGG
    TCTTCACCGC
201 CTTTTCCAGT ATGTTGGGGC AGCACAAAAA ACAGGCGGTC
    GACTGGAAAA
251 CCATATTTGC GATGATGCCG GGTATGATAT TCGGCGTATT
    CGCTGGCGCA
301 CTCTCCGCAA AATATATCCC CGCGTTCGGG CTTCAAATTT
    TCTTCATCCT
351 GTTTTTAACC GCCGTCGCAT TCAAAACACT GCATACCGGT
    CGTCAGACGG
401 CATCCCGCCC GCTGCCCGGG CTGCCCGGAC TGACTGCGGT
    TTCCACACTG
451 TTCGGCGCAA TGTCGAGCTG GGTCGGCATA GGCGGCGGTT
    CACTTTCCGT
501 CCCCTTCTTA ATCCACTGCG GCTTCCCCGC CCATAAAGCC
    ATCGGCACAT
551 CATCCGGCCT TGCCTGGCCG ATTGCACTCT CCGGCGCAAT
    ATCGTATCTG
601 GTCAACGGTC TGAATATTGC AGGATTGCCC GAAGGGTCGC
    TGGGCTTCCT
651 TTACCTGCCC GCCGTCGCCG TCCTCAGCGC GGCAACCATT
    GCCTTTGCCC
701 CGCTCGGTGT CAAAACCGCC CACAAACTTT CTTCTGCCAA
    ACTCAAAGAA
751 TCCTTCGGCA TTATGTTGCT TTTGATTGCC GGAAAAATGC
    TGTACAACCT
801 GCTTTAA
```

This corresponds to the amino acid sequence <SEQ ID 94; ORF17ng-1>:

```
  1 MWHWDIILIL LAVGSAAGFI AGLFGVGGGT LIVPVVLWVL
    DLQGLAQHPY
 51 AQHLAVGTSF AVMVFTAFSS MLGQHKKQAV DWKTIFAMMP
    GMIFGVFAGA
101 LSAKYIPAFG LQTFFILFLT AVAFKTLHTG RQTASRPLPG
    LPGLTAVSTL
151 FGAMSSWVGI GGGSLSVPFL IHCGFPAHKA IGTSSGLAWP
    IALSGAISYL
201 VNGLNIAGLP EGSLGFLYLP AVAVLSAATI AFAPLGVKTA
    HKLSSAKLKE
251 SFGIMLLLIA GKMLYNLL*
```

ORF17ng-1 and ORF17-1 show 96.6% identity in 268 aa overlap:

```
                  10        20        30        40        50        60
orf17-1.pep   MWHWDIILILLAVGSAAGFIAGLFGVGGGTLIVPVVLWVLDLQGLAQHPYAQHLAVGTSF
              ||||||||||||||||||||||||||||||||||||||||||||||||||||||||||||
orf17ng-1     MWHWDIILILLAVGSAAGFIAGLFGVGGGTLIVPVVLWVLDLQGLAQHPYAQHLAVGTSF
                  10        20        30        40        50        60

70        80        90       100       110       120
orf17-1.pep   AVMVFTAFSSMLGQHKKQAVDWKTVFTMMPGMIFGVFTGALSAKYIPAFGLQIFFILFLT
              ||||||||||||||||||||||||:|:||||||||||||:||||||||||||||||||||
orf17ng-1     AVMVFTAFSSMLGQHKKQAVDWKTIFAMMPGMIFGVFAGALSAKYIPAFGLQIFFILFLT
                  70        80        90       100       110       120

130       140       150       160       170       180
orf17-1.pep   AVAFKTLHTDPQTASRPLPGLPGLTAVSTLFGTMSSWVGIGGGSLSVPFLIHCGFPAHKA
              |||||||||| |||||||||||||||||||:|||||||||||||||||||||||||||||
orf17ng-1     AVAFKTLHTGRQTASRPLPGLPGLTAVSTLFGAMSSWVGIGGGSLSVPFLIHCGFPAHKA
                 130       140       150       160       170       180
```

-continued

```
                       190        200        210        220        230        240
orf17-1.pep    IGTSSGLAWPIALSGAISYLLNGLNIAGLPEGSLGFLYLPAVAVLSAATIAFAPLGVKTA
               ||||||||||||||||||||:|||||||||||||||||||||||||||||||||||||||
orf17ng-1      IGTSSGLAWPIALSGAISYLVNGLNIAGLPEGSLGFLYLPAVAVLSAATIAFAPLGVKTA
                       190        200        210        220        230        240
                       250        260        269
orf17-1.pep    HKLSSAKLKKXFGIMLLLIAGKMLYNLLX
               ||||||||||:||||||||||||||||||
orf17ng-1      HKLSSAKLKESFGIMLLLIAGKMLYNLLX
                       250        260
```

In addition, ORF17ng-1 shows significant homology with a hypothetical *H. influenzae* protein:

```
sp|P44070|Y902_HAEIN HYPOTHETICAL PROTEIN HI0902 pir||G64015
hypothetical protein HI0902 - Haemophilus influenzae (strain Rd KW20)
gi|1573922 (U32772) H. influenzae predicted coding region HI0902
[Haemophilus influenzae]Length = 264
  Score = 74 (34.9 bits), Expect = 1.6e - 23, Sum P(2) = 1.6e - 23
  Identities = 15/43 (34%), Positives = 23/43 (53%)

Query:  55 AVGTSFAVMVFTAFSSMLGQHKKQAVDWKTIFAMMPGMIFGVF              97
           A+GTSFA +V T   S    HK   + W+ +   + P ++  VF
Sbjct:  52 ALGTSFATIVITGIGSAQRHHKLGNIVWQAVRILAPVIMLSVF              94

Score = 195 (91.9 bits), Expect = 1.6e - 23, Sum P(2) = 1.6e - 23
  Identities = 44/114 (38%), Positives = 65/114 (57%)

Query: 150 LFGAMSSWVGIGGGSLSVPFLIHCGFPAHKAIGTSSGLAWPIALSGAISYLVNGLNIAGL  209
           L G  SS  GIGGG   VPFL   G     +AIG+S+     + +SG   S++V+G   +
Sbjct: 148 LIGMASSAAGIGGGGFIVPFLTARGINIKQAIGSSAFCGMLLGISGMFSFIVSGWGNPLM  207

Query: 210 PEGSLGFLYLPAVAVLSAATIAFAPLGVKTAHKLSSAKLKESFGIHLLLIAGKM        263
           PE SLG++YLPAV  ++A +    + LG      KL   + LK+ F + L+++A  M
Sbjct: 208 PEYSLGYIYLPAVLGITATSFFTSKLGASATAKLPVSTLKKGFALFLIVVAINM       261
```

This analysis, including the homology with the hypothetical *H. influenzae* transmembrane protein, suggests that the proteins from *N. meningitidis* and *N. gonorrhoeae*, and their epitopes, could be useful antigens for vaccines or diagnostics, or for raising antibodies.

Example 12

The following partial DNA sequence was identified in *N. meningitidis* <SEQ ID 95>:

```
  1..GGAAACGGAT GGCAGGCAGA CCCCGAACAT CCGCTGCTCG
     GGCTTTTTGC
 51  CGTCAGTAAT GTATCGATGA CGCTTGCTTT TGTCGGAATA
     TGTGCGTTGG
101  TGCATTATTG CTTTTCGGGA ACGGTTCAAG TGTTTGTGTT
     TGCGGCACTG
151  CTCAAACTTT ATGCGCTGAA GCCGGTTTAT TGGTTCGTGT
     TGCAGTTTGT
201  GCTGATGGCG GTTGCCTATG TCCACCGCTG CGGTATAGAC
     CGGCAGCCGC
251  CGTCAACGTT CGGCGGCTCG CAGCTGCGAC TCGGCGGGTT
     GACGGCAGCG
301  TTGATGCAGG TCTCGGTACT GGTGCTGCTC CTTTCAGAAA
     TTGGAAGATA
351  A
```

This corresponds to the amino acid sequence <SEQ ID 96; ORF18>:

```
  1..GNGWQADPEH PLLGLFAVSN VSMTLAFVGI CALVHYCFSG
     TVQVFVFAAL
 51  LKLYALKPVY WFVLQFVLMA VAYVHRCGID RQPPSTFGGS
     QLRLGGLTAA
101  LMQVSVLVLL LSEIGR*
```

Further work revealed the complete nucleotide sequence <SEQ ID 97>:

```
  1 ATGATTTTGC TGCATTTGGA TTTTTTGTCT GCCTTACTGT
    ATGCGGCGGT
 51 TTTTCTGTTT CTGATATTCC GCGCAGGAAT GTTGCAATGG
    TTTTGGGCGA
101 GTATTATGCT GTGGCTGGGC ATATCGGTTT TGGGGGCAAA
    GCTGATGCCC
151 GGCATATGGG GAATGACCCG CGCCGCGCCC TTGTTCATCC
    CCCATTTTTA
201 CCTGACTTTG GCAGCATAT TTTTTTTCAT CGGGCATTGG
    AACCGGAAAA
251 CAGATGGAAA CGGATGGCAG GCAGACCCCG AACATCCGCT
    GCTCGGGCTT
301 TTTGCCGTCA GTAATGTATC GATGACGCTT GCTTTTGTCG
    GAATATGTGC
```

-continued
```
351 GTTGGTGCAT TATTGCTTTT CGGGAACGGT TCAAGTGTTT
    GTGTTTGCGG

401 CACTGCTCAA ACTTTATGCG CTGAAGCCGG TTTATTGGTT
    CGTGTTGCAG

451 TTTGTGCTGA TGGCGGTTGC CTATGTCCAC CGCTGCGGTA
    TAGACCGGCA

501 GCCGCCGTCA ACGTTCGGCG GCTCGCAGCT GCGACTCGCC
    GGGTTGACGG

551 CAGCGTTGAT GCAGGTCTCG GTACTGGTGC TGCTGCTTTC
    AGAAATTGGA

601 AGATAA
```

This corresponds to the amino acid sequence <SEQ ID 98; ORF18-1>:

```
  1 MILLHLDFLS ALLYAAVFLF LIFRAGMLQW FWASIMLWLG
    ISVLGAKLMP

51 GIWGMTRAAP LFIPHFYLTL GSIFFFIGHW NRKTDGNGWQ
    ADPEHPLLGL

101 FAVSNVSMTL AFVGICALVH YCFSGTVQVF VFAALLKLYA
    LKPVYWFVLQ

151 FVLMAVAYVH RCGIDRQPPS TFGGSQLRLG GLTAALMQVS
    VLVLLLSEIG

201 R*
```

Computer analysis of this amino acid sequence gave the following results:

Homology with a Predicted ORF from *N. meningitidis* (Strain A)

ORF18 shows 98.3% identity over a 116aa overlap with an ORF (ORF18a) from strain A of *N. meningitidis*:

```
                              10         20         30
orf18.pep                 GNGWQADPEHPLLGLFAVSNVSMTLAFVGI
                          ||||||||||||||||||||||||||||||
orf18a    TRAAPLFIPHFYLTLGSIFFFIGHWNRKTDGNGWQADPEHPLLGLFAVSNVSMTLAFVGI
          60        70        80        90       100       110
                40         50         60         70         80         90
orf18.pep   CALVHYCFSGTVQVFVFAALLKLYALKPVYWFVLQFVLMAVAYVHRCGIDRQPPSTFGGS
            ||||||||| ||||||||||||||||||||||||||||||||||||||||||||||||||
orf18a      CALVHYCFSXTVQVFVFAALLKLYALKPVYWFVLQFVLMAVAYVHRCGIDRQPPSTFGGS
            120       130       140       150       160       170
                100        110
orf18.pep   QLRLGGLTAALMQVSVLVLLLSEIGRX
            |||||||||||||| ||||||||||||
orf18a      QLRLGGLTAALMQXSVLVLLLSEIGRX
            180       190       200
```

The complete length ORF18a nucleotide sequence <SEQ ID 99> is:

```
  1 ATGATTTTGC TGCATTTGGA TTTTTTGTCT GCCTTACTGT
    ATGCGGCGGT

51 TTTTCTGTTT CTGATATTCC GCGCAGGAAT GTTGCAATGG
    TTTTGGGCGA

101 GTATTATGCT GTGGCTGGGC ATATCGGTTT TGGGGGCAAA
    GCTGATGCCC
```

-continued
```
151 GGCATATGGG GAATGACCCG CGCCGCGCCC TTCTTCATCC
    CCCATTTTTA

201 CCTGACTTTG GGCAGCATAT TTTTTTTCAT CGGGCATTGG
    AACCGGAAAA

251 CGGATGGAAA CCGATGGCAG GCAGACCCCG AACATCCTCT
    GCTCGGGCTG

301 TTTGCCGTCA GTAATGTATC GATGACGCTT GCTTTTCTCG
    GAATATGTGC

351 GTTGGTGCAT TATTGCTTTT CGNGAACGGT TCAAGTGTTT
    GTGTTTGCGG

401 CACTGCTCAA ACTTTATGCG CTGAAGCCGG TTTATTGGTT
    CGTGTTGCAG

451 TTTGTGCTGA TGGCGGTTGC CTATGTCCAC CGCTGCGGTA
    TAGACCGGCA

501 GCCGCCGTCA ACGTTCGGCG GNTCGCAGCT GCGACTCGGC
    GGGTTGACGG

551 CAGCGTTGAT GCAGNTCTCG GTACTGGTGC TGGTGCTTTC
    AGAAATTGGA

601 AGATAA
```

This encodes a protein having amino acid sequence <SEQ ID 100>:

```
  1 MILLHLDFLS ALLYAAVFLF LIFRAGMLQW FWASIMLWLG
    ISVLGAKLMP

51 GIWGMTRAAP LFIPHFYLTL GSIFFFIGHW NRKTDGNGWQ
    ADPEHPLLGL
```

-continued
```
101 FAVSNVSMTL AFVGICALVH YCFSXTVQVF VFAALLKLYA
    LKPVYWFVLQ

151 FVLMAVAYVH RCGIDRQPPS TFGGSQLRLG GLTAALMQXS
    VLVLLLSEIG

201 R*
```

ORF18a and ORF18-1 show 99.0% identity in 201 aa overlap:

```
            10         20         30         40         50         60
orf18a.pep  MILLHLDFLSALLYAAVFLFLIFRAGMLQWFWASIMLWLGISVLGAKLMPGIWGMTRAAP
            ||||||||||||||||||||||||||||||||||||||||||||||||||||||||||||
orf18-1     MILLHLDFLSALLYAAVFLFLIFRAGMLQWFWASIMLWLGISVLGAKLMPGIWGMTRAAP
            10         20         30         40         50         60

70         80         90        100        110        120
orf18a.pep  LFIPHFYLTLGSIFFFIGHWNRKTDGNGWQADPEHPLLGLFAVSNVSMTLAFVGICALVH
            ||||||||||||||||||||||||||||||||||||||||||||||||||||||||||||
orf18-1     LFIPHFYLTLGSIFFFIGHWNRKTDGNGWQADPEHPLLGLFAVSNVSMTLAFVGICALVH
            70         80         90        100        110        120

130        140        150        160        170        180
orf18a.pep  YCFSXTVQVFVFAALLKLYALKPVYWFVLQFVLMAVAYVHRCGIDRQPPSTFGGSQLRLG
            ||||  ||||||||||||||||||||||||||||||||||||||||||||||||||||||
orf18-1     YCFSGTVQVFVFAALLKLYALKPVYWFVLQFVLMAVAYVHRCGIDRQPPSTFGGSQLRLG
            130        140        150        160        170        180

190        200
orf18a.pep  GLTAALMQXSVLVLLLSEIGRX
            |||||||| |||||||||||||
orf18-1     GLTAALMQVSVLVLLLSEIGRX
            190        200
```

Homology with a Predicted ORF from *N. gonorrhoeae*

ORF18 shows 93.1% identity over a 116aa overlap with a predicted ORF (ORF18.ng) from *N. gonorrhoeae*:

```
orf18.pep                           GNGWQADPEHPLLGLFAVSNVSMTLAFVGI   30
                                    |||||||||||||||||||||||||||||
orf18ng    TRAAPLFIPHFYLTLGSIFFFIGHWNRKTDGNGWQADPEHPLLGLFAVSNVSMTLAFVGI  115
orf18.pep  CALVHYCFSGTVQVFVFAALLKLYALKPVYWFVLQFVLMAVAYVHRCGIDRQPPSTFGGS   90
           ||||||||||||||||||||||||||||||||||||||||||||||||||||||||||||
orf18ng    CALVHYCFSGTVQVFVFAALLKLYALKPVYWFVLQFVLMAVAYVHRCGIDRQPPSTFGGS  175
orf18.pep  QLRLGGLTAALMQVSVLVLLLSEIGR  116
           ||||| :| ||||:|  ::||:||||
orf18ng    QLRLGVLAAMLQVAVTAMLLAEIGR   201
```

The complete length ORF18ng nucleotide sequence is <SEQ ID 101>:

```
  1 ATGATTTTGC TGCATTTCGA TTTTTTGTCT GCCTTACTGt
    aTGCGGcggt
 51 tttTctgTTT CTGATATTCC GCGCAGGAAT GTTGCAATGG
    TTTTGGGCGA
101 GTATTGCGTT GTGGCTCGCC ATCTCGGTTT TAGGGGTAAA
    GCTGATGCCG
151 GGGATGTGGG GAATGACCCG CGCCGCGCCT TTGTTCATCC
    CCCATTTTTA
201 CCTGACTTTG GGCAGCATAT TTTTTTTCAT CGGGTATTGG
    AACCGCAAAA
251 CAGATGGAAA CGGATGGCAG GCAGACCCCG AACATCCGCT
    GCTCGGGCTT
301 TTTGCCGTCA GTAATGTATC GATGACGCTT GCTTTTGTCG
    GAATATGTGC
351 GTTGGTGCAT TATTGCTTTT CGGGAACGGT TCAAGTGTTT
    GTGTTTGCGG
401 CATTGCTCAA AGTTTATGCG CTGAACCCGG TTTATTGCTT
    CGTGTTGCAG
451 TTTGTATTGA TGGCGGttgC CTATGTCCAC CGCTGCGGTA
    TAGACCGGCA
501 GCCGCCGTCA ACGTTCGGCG GTTCGCAGCT GCGACTCGGC
    GTGTTGGCGG
551 CGATGTTGAT GCAGGTTGCG GTAACGGCGA TGCTGCTTGC
    CGAAATCGGC
601 AGATGA
```

This encodes a protein having amino acid sequence <SEQ ID 102>:

```
  1 MILLHLDFLS ALLYAAVFLF LIFRAGMLQW FWASIALWLG
    ISVLGVKLMP
 51 GMWGMTRAAP LFIPHFYLTL GSIFFFIGYW NRKTDGNGWQ
    ADPEHPLLGL
101 FAVSNVSMTL AFVGICALVH YCFSGTVQVF VFAALLKLYA
    LKPVYWFVLQ
151 FVLMAVAYVH RCGIDRQPPS TFGGSQLRLG VLAAMLQVA
    VTAMLLAEIG
201 R*
```

This ORF18ng protein sequence shows 94.0% identity in 201 aa overlap with ORF18-1:

```
              10         20         30         40         50         60
orf18-1.pep   MILLHLDFLSALLYAAVFLFLIFRAGMLQWFWASIMLWLGISVLGAKLMPGIWGMTRAAP
              ||||||||||||||||||||||||||||||||| ||||||||:||||:||||||||||
orf18ng       MILLHLDFLSALLYAAVFLFLIFRAGMLQWFWASIALWLGISVLGVKLMPGMWGMTRAAP
              10         20         30         40         50         60

70         80         90        100        110        120
orf18-1.pep   LFIPHFYLTLGSIFFFIGHWNRKTDGNGWQADPEHPLLGLFAVSNVSMTLAFVGICALVH
              ||||||||||||||||||:|||||||||||||||||||||||||||||||||||||||||
orf18ng       LFIPHFYLTLGSIFFFIGYWNRKTDGNGWQADPEHPLLGLFAVSNVSMTLAFVGICALVH
              70         80         90        100        110        120

130        140        150        160        170        180
orf18-1.pep   YCFSGTVQVFVFAALLKLYALKPVYWFVLQFVLMAVAYVHRCGIDRQPPSTFGGSQLRLG
              ||||||||||||||||||||||||||||||||||||||||||||||||||||||||||||
orf18ng       YCFSGTVQVFVFAALLKLYALKPVYWFVLQFVLMAVAYVHRCGIDRQPPSTFGGSQLRLG
              130        140        150        160        170        180

190        200
orf18-1.pep   GLTAALMQVSVLVLLLSEIGRX
              |:| ||||:| ::||:||||||
orf18ng       VLAAMLMQVAVTAMLLAEIGRX
              190        200
```

Based on this analysis, including the presence of several putative transmembrane domains in the gonococcal protein, it is predicted that the proteins from N. meningitidis and N. gonorrhoeae, and their epitopes, could be useful antigens for vaccines or diagnostics, or for raising antibodies.

Example 13

The following partial DNA sequence was identified in N. meningitidis <SEQ ID 103>:

```
  1 ATGAAAACCC CACTCCTCAA GCCTCTGCTN ATTACCTCGC
    TTCCCGTTTT
 51 CGCCAGTGTT TTTACCGCCG CCTCCATCGT CTGGCAGCTA
    GGCGAACCCA
```

-continued
```
101 AGCTCGCCAT GCCCTTCGTA CTCGGCATCA TCGCCGGCGG
    CCTTGTCGAT
151 TTGGACAACC NCNTGACCGG ACGGCTNAAA AACATCATCA
    CCACCGTCGC
201 CCTGTTCACC CTCTCCTCGC TCACGGCACA AAGCACCCTC
    GGCACAGGGC
251 TGCCCTTCAT CCTCGCCATG ACCCTGATGA CTT.CG.CTT
    CACCATTTTA
301 GGCGCGGNCG ...
```

This corresponds to the amino acid sequence <SEQ ID 104; ORF19>:

```
  1 MKTPLLKPLL TTSLPVFASV FTAASIVWQL GEPKLAMPFV LGIIAGGLVD
 51 LDNXXTGRLK NIITTVALFT LSSLTAQSTL GTGLPFILAM TLMTXXFTIL
101 GAX...
```

Further work revealed the complete nucleotide sequence <SEQ ID 105>:

```
  1 ATGAAAACCC CACTCCTCAA GCCTCTGCTC ATTACCTCGC TTCCCGTTTT
 51 CGCCAGTGTT TTTACCGCCG CCTCCATCGT CTGGCAGCTA GGCGAACCCA
101 AGCTCGCCAT GCCCTTCGTA CTCGGCATCA TCGCCGGCGG CCTTGTCGAT
151 TTGGACAACC GCCTGACCGG ACGGCTGAAA AACATCATCA CCACCGTCGC
201 CCTGTTCACC CTCTCCTCGC TCACGGCACA AAGCACCCTC GGCACAGGGC
251 TGCCCTTCAT CCTCGCCATG ACCCTGATGA CCTTCGGCTT CACCATTTTA
301 GGCGCGGTCG GGCTCAAATA CCGCACCTTC GCCTTCGGTG CACTCGCCGT
351 CGCCACCTAC ACCACACTTA CCTACACCCC CGAAACCTAC TGGCTGACCA
401 ACCCCTTCAT GATTTATGC GGCACCGTAC TGTACAGCAC CGCCATCCTC
```

-continued

```
 451 CTGTTCCAAA TCGTCCTGCC CCACCGCCCC GTCCAAGAAA GCGTCGCCAA

501 CGCCTACGAC GCACTCGGCG GCTACCTCGA AGCCAAAGCC GACTTCTTCG

551 ACCCCGATGA GGCAGCCTGG ATAGGCAACC GCCACATCGA CCTCGCCATG

601 AGCAACACCG GCGTCATCAC CGCCTTCAAC CAATGCCGTT CCGCCCTGTT

651 TTACCGCCTT CGCGGCAAAC ACCGCCACCC GCGCACCGCC AAAATGCTGC

701 GTTACTACTT TGCCGCCCAA GACATACACG AACGCATCAG CTCCGCCCAC

751 GTCGATTATC AGGAAATGTC CGAAAAATTC AAAAACACCG ACATCATCTT

801 CCGCATCCAC CGCCTGCTCG AAATGCAGGG ACAAGCCTGC CGCAACACCG

851 CCCAAGCCCT GCGCGCAAGC AAAGACTACG TTTACAGCAA ACGCCTCGGC

901 CGCGCCATCG AAGGCTGCCG CCAATCGCTG CGCCTCCTTT CAGACAGCAA

951 CGACAGTCCC GACATCCGCC ACCTGCGCCG CCTTCTCGAC AACCTCGGCA

1001 GCGTCGACCA GCAGTTCCGC CAACTCCAGC ACAACGGCCT GCAGGCAGAA

1051 AACGACCGCA TGGGCGACAC CCGCATCGCC GCCCTCGAAA CCAGCAGCCT

1101 CAAAAACACC TGGCAGGCAA TCCGTCCGCA GCTAAACCTC GAATCAGGCG

1151 TATTCCGCCA TGCCGTCCGC CTGTCCCTCG TCGTTGCCGC CGCCTGCACC

1201 ATCGTCGAAG CCCTCAACCT CAACCTCGGC TACTGGATAC TACTGACCGC

1251 CCTTTTCGTC TGCCAACCCA ACTACACCGC CACCAAAAGC CGCGTCCGCC

1301 AGCGCATCGC CGGCACCGTA CTCGGCGTAA TCGTCGGCTC GCTCGTCCCC

1351 TACTTCACCC CGTCTGTCGA AACCAAACTC TGGATTGTCA TCGCCAGTAC

1401 CACCCTCTTT TTCATGACCC GCACCTACAA ATACAGTTTC TCCACCTTCT

1451 TCATTACCAT TCAAGCCCTG ACCAGCCTCT CCCTCGCAGG TTTGGACGTA

1501 TACGCCGCCA TGCCCGTACG CATCATCGAC ACCATTATCG GCGCATCCCT

1551 TGCCTGGGCG GCAGTCAGCT ACCTGTGGCC AGACTGGAAA TACCTCACGC

1601 TCGAACGCAC CGCCGCCCTT GCCGTATGCA GCAACGGTGC CTATCTCGAA

1651 AAAATCACCG AACGCCTCAA AAGCGGCGAA ACCGGCGACG ACGTCGAATA

1701 CCGCGCCACC CGCCGCCGCG CCCACGAACA CACCGCCGCC CTCAGCAGCA

1751 CCCTTTCCGA CATGAGCAGC GAACCCGCAA AATTCGCCGA CAGCCTGCAA

1801 CCCGGCTTTA CCCTGCTCAA AACCGGCTAC GCCCTGACCG GCTACATCTC

1851 CGCCCTCGGC GCATACCGCA GCGAAATGCA CGAAGAATGC AGCCCCGACT

1901 TTACCGCACA GTTCCACCTC GCCGCCGAAC ACACCGCCCA CATCTTCCAA

1951 CACCTGCCCG AAACCGAACC CGACGACTTT CAGACAGCAC TGGATACACT

2001 GCGCGGCGAA CTCGACACCC TCCGCACCCA CAGCAGCGGA ACACAAAGCC

2051 ACATCCTCCT CCAACAGCTC CAACTCATCG CCCGACAGCT CGAACCCTAC

2101 TACCGCGCCT ACCGCCAAAT TCCGCACAGG CAGCCCCAAA ATGCAGCCTG

2151 A
```

This corresponds to the amino acid sequence <SEQ ID 106; ORF19-1>:

```
  1 MKTPLLKPLL ITSLPVFASV FTAASIVWQL GEPKLAMPFV LGIIAGGLVD

51 LDNRLTGRLK NIITTVALFT LSSLTAQSTL GTGLPFILAM TLMTFGFTIL

101 GAVGLKYRTF AFGALAVATY TTLTYTPETY WLTNPFMILC GTVLYSTAIL

151 LFQIVLPHRP VQESVANAYD ALGGYLEAKA DFFDPDEAAW IGNRHIDLAM

201 SNTGVITAFN QCRSALFYRL RGKHRHPRTA KMLRYYFAAQ DIHERISSAH

251 VDYQEMSEKF KNTDIIFRIH RLLEMQGQAC RNTAQALRAS KDYVYSKRLG

301 RAIEGCRQSL RLLSDSNDSP DIRHLRRLLD NLGSVDQQFR QLQHNGLQAE

351 NDRMGDTRIA ALETSSLKNT WQAIRPQLNL ESGVFRHAVR LSLVVAAACT

401 IVEALNLNLG YWTLLTALFV CQPNYTATKS RVRQRIAGTV LGVIVGSLVP

451 YFTPSVETKL WIVIASTTLF FMTRTYKYSF STFFITIQAL TSLSLAGLDV

501 YAAMPVRIID TIIGASLAWA AVSYLWPDWK YLTLERTAAL AVCSNGAYLE

551 KITERLKSGE TGDDVEYRAT RRRAHEHTAA LSSTLSDMSS EPAKFADSLQ

601 PGFTLLKTGY ALTGYISALG AYRSEMHEEC SPDFTAQFHL AAEHTAHIFQ

651 HLPETEPDDF QTALDTLRGE LDTLRTHSSG TQSHILLQQL QLIARQLEPY

701 YRAYRQIPHR QPQNAA*
```

Computer analysis of this amino acid sequence gave the following results:

Homology with Predicted Transmembrane Protein YHFK of *H. influenzae* (Accession Number P44289)
ORF19 and YHFK proteins show 45% aa identity in 97 aa overlap:

```
orf19    6 LKPLLITSLPVFASVFTAASIVWQLGEPKLAMPFVLGIIAGGLVDLDNXXTGRLKNIITT 65
           L  +I+++PVF +V  AA  +W      +MP +LGIIAGGLVDLDN  TGRLKN+  T
YHFK     5 LNAKVISTIPVFIAVNIAAVGIWFFDISSQSMPLILGIIAGGLVDLDNRLTGRLKNVFFT 64 orf19   66 VALFTLSSLTAQSTLGTGLPFILAMTLMTXXFTILGA                        102
           +  F++SS   Q +G  + +I+ MT++T   FT++GA
YHFK    65 LIAFSISSFIVQLHIGKPIQYIVLMTVLTFIFTMIGA                        101
```

Homology with a Predicted ORF from *N. meningitidis* (Strain A)
ORF19 shows 92.2% identity over a 102aa overlap with an ORF (ORF19a) from strain A of *N. meningitidis*.

```
                    10         20         30         40         50         60
orf19.pep   MKTPLLKPLLITSLPVFASVFTAASIVWQLGEPKLAMPFVLGIIAGGLVDLDNXXTGRLK
            ||||  |||||||||||||||||||||||||||||||||||||||||||||||  |||||
orf19a      MKTPPLKPLLITSLPVFASVFTAASIVWQLGEPKLAMPFVLGIIAGGLVDLDNRLTGRLK
                    10         20         30         40         50         60
                    70         80         90        100
orf19.pep   NIITTVALFTLSSLTAQSTLGTGLPFILAMTLMTXXFTILGAX
            |||:||||||||||:||||||||||||||||||||   |||:||
orf19a      NIIATVALFTLSSLVAQSTLGTGLPFILAMTLMTFGFTIMGAVGLKYRTFAFGALAVATY
                    70         80         90        100        110        120
orf19a      TTLTYTPETYWLTNPFMILCGTVLYSTAIILFQIILPHRPVQENVANAYEALGSYLEAKA
                   130        140        150        160        170        180
```

The complete length ORF19a nucleotide sequence <SEQ ID 107> is:

```
   1 ATGAAAACCC CACCCCTCAA GCCTCTGCTC ATTACCTCGC TTCCCGTTTT
  51 CGCCAGTGTC TTTACCGCCG CCTCCATCGT CTGGCAGCTG GGCGAACCCA
 101 AGCTCGCCAT GCCCTTCGTA CTCGGCATCA TCGCTGGCGG CCTGGTCGAT
 151 TTGGACAACC GCCTGACCGG ACGGCTGAAA AACATCATCG CCACCGTCGC
 201 CCTGTTCACC CTCTCCTCAC TTGTCGCGCA AAGCACCCTC GGCACAGGTT
 251 TGCCATTCAT CCTCGCCATG ACCCTGATGA CTTTCGGCTT TACCATCATG
 301 GGCGCGGTCG CGCTGAAATA CCGCACCTTC GCCTTCGGCG CACTCGCCGT
 351 CGCCACCTAC ACCACACTTA CCTACACCCC CGAAACCTAC TGGCTGACCA
 401 ACCCCTTTAT GATTCTGTGC GGAACCGTAC TGTACAGCAC CGCCATCATC
 451 CTGTTCCAAA TCATCCTGCC CCACCGCCCC GTTCAAGAAA ACGTCGCCAA
 501 CGCCTACGAA GCACTCGGCA GCTACCTCGA AGCCAAAGCC GACTTTTTCG
 551 ATCCCGACGA AGCCGAATGG ATAGGCAACC GCCACATCGA CCTCGCCATG
 601 AGCAACACCG GCGTCATCAC CGCCTTCAAC CAATGCCGTT CCGCCCTGTT
 651 TTACCGCCTT CGCGGCAAAC ACCGCCACCC GCGCACCGCC AAAATGCTGC
 701 GCTACTACTT CGCCGCCCAA GACATACACG AACGCATCAG CTCCGCCCAC
 751 GTCGACTACC AAGAGATGTC CGAAAAATTC AAAAACACCG ACATCATCTT
 801 CCGCATCCAC CGCCTGCTCG AAATGCAGGG ACAAGCCTGC CGCAACACCG
 851 CCCAAGCCCT GCGCGCAAGC AAAGACTACG TTTACAGCAA ACGCCTCGGC
 901 CGCGCCATCG AAGGCTGCCG CCAATCGCTG CGCCTCCTTT CAGACAGCAA
 951 CGACAATCCC GACATCCGCC ACCTGCGCCG CCTTCTCGAC AACCTCGGCA
1001 GCGTCGACCA GCAGTTCCGC CAACTCCAGC ACAACGGCCT GCAGGCAGAA
1051 AACGACCGCA TGGGCGACAC CCGCATCGCC GCCCTCGAAA CCGGCAGCCT
1101 CAAAAACACC TGGCAGGCAA TCCGTCCGCA GCTAAACCTC GAATCAGGCG
1151 TATTCCGCCA TGCCGTCCGC CTGTCCCTTG TCGTTGCCGC CGCCTGCACC
1201 ATCGTCGAAG CCCTCAACCT CAACCTCGGC TACTGGATAC TACTGACCGC
1251 CCTTTTCGTC TGCCAACCCA ACTACACCGC CACCAAAAGC CGCGTCCGCC
1301 AGCGCATCGC CGGCACCGTA CTCGGCGTAA TCGTCGGCTC GCTCGTCCCC
1351 TACTTTACCC CCTCCGTCGA AACCAAACTC TGGATCGTCA TCGCCAGTAC
1401 CACCCTCTTT TTCATGACCC GCACCTACAA ATACAGCTTC TCGACATTTT
1451 TCATCACCAT TCAAGCCCTG ACCAGCCTCT CCCTCGCAGG GTTGGACGTA
1501 TACGCCGCCA TGCCCGTACG CATCATCGAC ACCATTATCG GCGCATCCCT
1551 TGCCTGGGCG GCAGTCAGCT ACCTGTGGCC AGACTGGAAA TACCTCACGC
1601 TCGAACGCAC CGCCGCCCTT GCCGTATGCA GCAACGGCGC CTATCTCGAA
1651 AAAATCACCG AACGCCTCAA AGCGGCGAA ACCGGCGACG ACGTCGAATA
1701 CCGCGCCACC CGCCGCCGCG CCCACGAACA CACCGCCGCC CTCAGCAGCA
1751 CCCTTTCCGA CATGAGCAGC GAACCCGCAA AATTCGCCGA CAGCCTGCAA
1801 CCCGGCTTTA CCCTGCTCAA AACCGGCTAC GCCCTGACCG GCTACATCTC
1851 CGCCCTCGGC GCATACCGCA GCGAAATGCA CGAAGAATGC AGCCCCGACT
1901 TTACCGCACA GTTCCACCTC GCCGCCGAAC ACACCGCCCA CATCTTCCAA
1951 CACCTGCCCG AAACCGAACC CGACGACTTT CAGACAGCAC TGGATACACT
```

```
2001 GCGCGGCGAA CTCGACACCC TCCGCACCCA CAGCAGCGGA ACACAAAGCC

2051 ACATCCTCCT CCAACAGCTC CAACTCATCG CCCGGCAGCT CGAACCCTAC

2101 TACCGCGCCT ACCGACAAAT TCCGCACAGG CAGCCCCAAA ACGCAGCCTG

2151 A
```

This encodes a protein having amino acid sequence <SEQ ID 108>:

```
  1 MKTPPLKPLL ITSLPVFASV FTAASIVWQL GEPKLAMPFV LGIIAGGLVD

51 LDNRLTGRLK NIIATVALFT LSSLVAQSTL GTGLPFILAM TLMTFGFTIM

101 GAVGLKYRTF AFGALAVATY TTLTYTPETY WLTNPFMILC GTVLYSTAII

151 LFQIILPHRP VQENVANAYE ALGSYLEAKA DFFDPDEAEW IGNRHIDLAM

201 SNTGVITAFN QCRSALFYRL RGKHRHPRTA KMLRYYFAAQ DIHERISSAH

251 VDYQEMSEKF KNTDIIFRIH RLLEMQGQAC RNTAQALRAS KDYVYSKRLG

301 RAIEGCRQSL RLLSDSNDNP DIRHLRRLLD NLGSVDQQFR QLQHNGLQAE

351 NDRMGDTRIA ALETGSLKNT WQAIRPQLNL ESGVFRHAVR LSLVVAAACT

401 IVEALNLNLG YWILLTALFV CQPNYTATKS RVRQRIAGTV LGVIVGSLVP

451 YFTPSVETKL WIVIASTTLF FMTRTYKYSF STFFITIQAL TSLSLAGLDV

501 YAAMPVRIID TIIGASLAWA AVSYLWPDWK YLTLERTAAL AVCSNGAYLE

551 KITERLKSGE TGDDVEYRAT RRRAHEHTAA LSSTLSDMSS EPAKFADSLQ

601 PGFTLLKTGY ALTGYISALG AYRSEMHEEC SPDFTAQFHL AAEHTAHIFQ

651 HLPETEPDDF QTALDTLRGE LDTLRTHSSG TQSHILLQQL QLIARQLEPY

701 YRAYRQIPHR QPQNAA*
```

ORF19a and ORF19-1 show 98.3% identity in 716 aa overlap:

```
                   10         20         30         40         50         60
   orf19a.pep  MKTPPLKPLLITSLPVFASVFTAASIVWQLGEPKLAMPFVLGIIAGGLVDLDNRLTGRLK
               ||||:|||||||||||||||||||||||||||||||||||||||||||||||||||||||
   orf19-1     MKTPLLKPLLITSLPVFASVFTAASIVWQLGEPKLAMPFVLGIIAGGLVDLDNRLTGRLK
                   10         20         30         40         50         60

70         80         90        100        110        120
   orf19a.pep  NIIATVALFTLSSLVAQSTLGTGLPFILAMTLMTFGFTIMGAVGLKYRTFAFGALAVATY
               |||:||||||||||:|||||||||||||||||||||||||:|||||||||||||||||||
   orf19-1     NIITTVALFTLSSLTAQSTLGTGLPFILAMTLMTFGFTILGAVGLKYRTFAFGALAVATY
                   70         80         90        100        110        120

130        140        150        160        170        180
   orf19a.pep  TTLTYTPETYWLTNPFMILCGTVLYSTAIILFQIILPHRPVQENVANAYEALGSYLEAKA
               |||||||||||||||||||||||||||||:||||:||||||||||:|||:|:||||||||
   orf19-1     TTLTYTPETYWLTNPFMILCGTVLYSTAILLFQIVLPHRPVQESVANAYDALGGYLEAKA
                  130        140        150        160        170        180

190        200        210        220        230        240
   orf19a.pep  DFFDPDEAEWIGNRHIDLAMSNTGVITAFNQCRSALFYRLRGKHRHPRTAKMLRYYFAAQ
               ||||||||:|||||||||||||||||||||||||||||||||||||||||||||||||||
   orf19-1     DFFDPDEAAWIGNRHIDLAMSNTGVITAFNQCRSALFYRLRGKHRHPRTAKMLRYYFAAQ
                  190        200        210        220        230        240

250        260        270        280        290        300
   orf19a.pep  DIHERISSAHVDYQEMSEKFKNTDIIFRIHRLLEMQGQACRNTAQALRASKDYVYSKRLG
               ||||||||||||||||||||||||||||||||||||||||||||||||||||||||||||
   orf19-1     DIHERISSAHVDYQEMSEKFKNTDIIFRIHRLLEMQGQACRNTAQALRASKDYVYSKRLG
                  250        260        270        280        290        300
```

```
                    -continued
                 310        320        330        340        350        360
orf19a.pep  RAIEGCRQSLRLLSDSNDNPDIRHLRRLLDNLGSVDQQFRQLQHNGLQAENDRMGDTRIA
            ||||||||||||||||:|||||||||||||||||||||||||||||||||||||||||||
orf19-1     RAIEGCRQSLRLLSDSNDSPDIRHLRRLLDNLGSVDQQFRQLQHNGLQAENDRMGDTRIA
                 310        320        330        340        350        360
                 370        380        390        400        410        420
orf19a.pep  ALETGSLKNTWQAIRPQLNLESGVFRHAVRLSLVVAAACTIVEALNLNLGYWILLTALFV
            ||||:|||||||||||||||||||||||||||||||||||||||||||||||||||||||
orf19-1     ALETSSLKNTWQAIRPQLNLESGVFRHAVRLSLVVAAACTIVEALNLNLGYWILLTALFV
                 370        380        390        400        410        420
                 430        440        450        460        470        480
orf19a.pep  CQPNYTATKSRVRQRIAGTVLGVIVGSLVPYFTPSVETKLWIVIASTTLFFMTRTYKYSF
            ||||||||||||||||||||||||||||||||||||||||||||||||||||||||||||
orf19-1     CQPNYTATKSRVRQRIAGTVLGVIVGSLVPYFTPSVETKLWIVIASTTLFFMTRTYKYSF
                 430        440        450        460        470        480
                 490        500        510        520        530        540
orf19a.pep  STFFITIQALTSLSLAGLDVYAAMPVRIIDTIIGASLAWAAVSYLWPDWKYLTLERTAAL
            ||||||||||||||||||||||||||||||||||||||||||||||||||||||||||||
orf19-1     STFFITIQALTSLSLAGLDVYAAMPVRIIDTIIGASLAWAAVSYLWPDWKYLTLERTAAL
                 490        500        510        520        530        540
                 550        560        570        580        590        600
orf19a.pep  AVCSNGAYLEKITERLKSGETGDDVEYRATRRRAHEHTAALSSTLSDMSSEPAKFADSLQ
            ||||||||||||||||||||||||||||||||||||||||||||||||||||||||||||
orf19-1     AVCSNGAYLEKITERLKSGETGDDVEYRATRRRAHEHTAALSSTLSDMSSEPAKFADSLQ
                 550        560        570        580        590        600
                 610        620        630        640        650        660
orf19a.pep  PGFTLLKTGYALTGYISALGAYRSEMHEECSPDFTAQFHLAAEHTAHIFQHLPETEPDDF
            ||||||||||||||||||||||||||||||||||||||||||||||||||||||||||||
orf19-1     PGFTLLKTGYALTGYISALGAYRSEMHEECSPDFTAQFHLAAEHTAHIFQHLPETEPDDF
                 610        620        630        640        650        660
                 670        680        690        700        710
orf19a.pep  QTALDTLRGELDTLRTHSSGTQSHILLQQLQLIARQLEPYYRAYRQIPHRQPQNAAX
            |||||||||||||||||||||||||||||||||||||||||||||||||||||||||
orf19-1     QTALDTLRGELDTLRTHSSGTQSHILLQQLQLIARQLEPYYRAYRQIPHRQPQNAAX
                 670        680        690        700        710
```

Homology with a Predicted ORF from *N. gonorrhoeae*

ORF19 shows 95.1% identity over a 102aa overlap with a predicted ORF (ORF19.ng) from *N. gonorrhoeae*:

```
orf19.pep   MKTPLLKPLLITSLPVFASVFTAASIVWQLGEPKLAMPFVLGIIAGGLVDLDNXXTGRLK    60
            |||||||||||||||||||||||||||||||||||||||||||||||||||||  ||||
orf19ng     MKTPLLKPLLITSLPVFASVFTAASIVWQLGEPKLAMPFVLGIIAGGLVDLDNRLTGRLK    60 orf19.pep   NIITTVALFTLSSLTAQSTLGTGLPFILAMTLMTXXFTILGAX                  103
            ||| :|||||||||||||||||||||||||||||  ||||||
orf19ng     NIIATVALFTLSSLTAQSTLGTGLPFILAMTLMTFGFTILGAVGLKYRTFAFGALAVATY 120
```

An ORF19ng nucleotide sequence <SEQ ID 109> is predicted to encode a protein having amino acid sequence <SEQ ID 110>:

```
  1 MKTPLLKPLL ITSLPVFASV FTAASIVWQL GEPKLAMPFV LGIIAGGLVD

51 LDNRLTGRLK NIIATVALFT LSSLTAQSTL GTGLPFILAM TLMTFGFTIL

101 GAVGLKYRTF AFGALAVATY TTLTYTPETY WLTNPFMILC GTVLYSTAII

151 LFQIILPHRP VQESVANAYE ALGGYLEAKA DFFDPDEAAW IGNRHIDLAM

201 SNTGVITAFN QCRSALFYRL RGKHRHPRTA KMLRYYFAAQ DIHERISSAH

251 VDYQEMSEKF KNTDIIFRIR RLLEMQGQAC RNTAQAIRSG KDYVYSKRLG

301 RAIEGCRQSL RLLSDGNDSP DIRHLSRLLD NLGSVDQQFR QLRHSDSPAE

351 NDRMGDTRIA ALETGSFKNT *
```

Further work revealed the complete nucleotide sequence
<SEQ ID 111>:

```
   1 ATGAAAACCC CACTCCTCAA GCCTCTGCTC ATTACCTCGC TTCCCGTTTT
  51 CGCCAGTCTC TTTACCGCCG CCTCCATCGT CTGGCAGCTA GGCGAACCCA
 101 AGCTCGCCAT GCCCTTCGTA CTCGGCATCA TCGCCGGCGG CCTGGTCGAT
 151 TTGGACAACC GCCTGACCGG ACGGCTGAAA ACATCATCG CCACCGTCGC
 201 CCTGTTTACC CTCTCCTCGC TCACGGCGCA AAGCACCCTC GGCACAGGGC
 251 TGCCCTTCAT CCTCGCCATC ACCCTGATGA CCTTCGGCTT TACCATTTTA
 301 GGCGCGGTCG GGCTGAAATA CCGCACCTTC GCCTTCGGCG CACTCGCCGT
 351 CGCCACCTAC ACCACGCTTA CCTACACCCC CGAAACCTAC TGGCTGACCA
 401 ACCCCTTCAT GATTTTATGC GGCACCGTAC TGTACAGCAC CGCCATCATC
 451 CTGTTCCAAA TCATCCTGCC CCACCGCCCC GTCCAAGAAA GCGTCGCCAA
 501 TGCCTACGAA GCACTCGGCG GCTACCTCGA AGCCAAAGCC GACTTCTTCG
 551 ACCCCGATGA GGCAGCCTGG ATAGGCAACC GCCACATCGA CCTCGCCATG
 601 AGCAACACCG GCGTCATCAC CGCCTTCAAC CAATGCCGTT CCGCCCTGTT
 651 TTACCGTTTG CGCGGCAAAC ACCGCCACCC GCGCACCGCC AAAATGCTGC
 701 GCTACTACTT CGCCGCCCAA GACATCCACG AACGCATCAG CTCCGCCCAC
 751 GTCGACTACC AAGAGATGTC CGAAAAATTC AAAAACACCG ACATCATCTT
 801 CCGCATCCGC CGCCTGCTCG AAATGCAGGG GCAGGCGTGC CGCAACACCG
 851 CCCAAGCCAT CCGGTCGGGC AAAGACTAcg tTTACAGCAA ACGCCTCGGA
 901 CGCGCCATcg aaggctgCCG CCAGTCGCtg cgcctCCTTt cagacggcaA
 951 CGACAGTCCC GACATCCGCC ACCTGAGCcg CCTTCTCGAC AACCTCGgca
1001 GCGTcgacca gcagtTCcgc caactCCGAC ACAgcgactC CCCCGCcgaa
1051 Aacgaccgca tgggcgacaC CCGCATCGCC GCCCtcgaaa ccggcagctT
1101 caaaaaCAcc tggcaggCAA TCCGTCCGCa gctgaaCCTC CAATCatgCG
1151 TATTCCGCCA TGCCGTCCGC CTGTCCCTCG TCGTTGCCGC CGCCTGCACC
1201 ATCGTCgaag cCCTCAACCT CAACCTCGGC TACTGGATAC TGCTGACCGC
1251 CCTTTTCGTC TGCCAACCCA ACTACACCGC CACCAAAAGC CGCGTGTACC
1301 AACGCATCGC CGGCACCGTA CTCGGCGTAA TCGTCGGCTC GCTCGTCCCC
1351 TACTTCACCC CCTCCGTCGA AACCAAACTC TGGATTGTCA TCGCCGGTAC
1401 CACCCTGTTC TTCATGACCC GCACCTACAA ATACAGTTTC TCCACCTTCT
1451 TCATCACCAT TCAGGCACTG ACCAGCCTCT CCCTCGCAGG TTTGGACGTA
1501 TACGCCGCCA TGCCCGTGCG CATCATcgaC ACCATTATCG GCGCATCCCT
1551 TGCCTGGGCG GCGGTCAGCT ACCTGTGGCC AGACTGGAAA TACCTCACGC
1601 TCGAACGCAC CGCCGCCCTT GCCGTATGCA GCAGCGGCAC ATACCTCCAA
1651 AAAATTGCCG AACGCCTCAA AACCGGCGAA ACCGGCGACG ACATAGAATA
1701 CCGCATCACC CGCCGCCGCG CCCACGAACA CACCGCCGCC CTCAGCAGCA
1751 CCCTTTCCGA CATGAGCAGC GAACCCGCAA AATTCGCCGA CAGCCTGCAA
1801 CCCGGCTTTA CCCTGCTCAA AACCGGCTAC GCCCTGACCG GCTACATCTC
1851 CGCCCTCGGC GCATACCGCA GCGAAATGCA CGAAGAATGC AGCCCCGACT
```

```
1901 TTACCGCACA GTTCCACCTT GCCGCCGAAC ACACCGCCCA CATCTTCCAA

1951 CACCTGCCCG ACATGGGACC CGACGACTTT CAGACGGCAT GGATACACT

2001 GCGCGGCGAA CTCGGCACCC TCCGCACCCG CAGCAGCGGA ACACAAAGCC

2051 ACATCCTCCT CCAACAGCTC CAACTCATCG CccgGCAACT CGAACCCTAC

2101 TACCGCGCCT ACCGACAAAT TCCGCACAGG CAGCCCCAAA ACGCAGCCTG

2151 A
```

This corresponds to the amino acid sequence <SEQ ID 112; ORF19ng-1>:

```
  1 MKTPLLKPLL ITSLPVFASV FTAASIVWQL GEPKLAMPFV LGIIAGGLVD

51 LDNRLTGRLK NIIATVALFT LSSLTAQSTL GTGLPFILAM TLMTFGFTIL

101 GAVGLKYRTF AFGALAVATY TTLTYTPETY WLTNPFMILC GTVLYSTAII

151 LFQIILPHRP VQESVANAYE ALGGYLEAKA DFFDPDEAAW IGNRHIDLAM

201 SNTGVITAFN QCRSALFYRL RGKHRHPRTA KMLRYYFAAQ DIHERISSAH

251 VDYQEMSEKF KNTDIIFRIR RLLEMQGQAC RNTAQAIRSG KDYVYSKRLG

301 RAIEGCRQSL RLLSDGNDSP DIRHLSRLLD NLGSVDQQFR QLRHSDSPAE

351 NDRMGDTRIA ALETGSFKNT WQAIRPQLNL ESCVFRHAVR LSLVVAAACT

401 IVEALNLNLG YWILLTALFV CQPNYTATKS RVYQRIAGTV LGVIVGSLVP

451 YFTPSVETKL WIVIAGTTLF FMTRTYKYSF STFFITIQAL TSLSLAGLDV

501 YAAMPVRIID TIIGASLAWA AVSYLWPDWK YLTLERTAAL AVCSSGTYLQ

551 KIAERLKTGE TGDDIEYRIT RRRAHEHTAA LSSTLSDMSS EPAKFADSLQ

601 PGFTLLKTGY ALTGYISALG AYRSEMHEEC SPDFTAQFHL AAEHTAHIFQ

651 HLPDMGPDDF QTALDTLRGE LGTLRTRSSG TQSHILLQQL QLIARQLEPY

701 YRAYRQIPHR QPQNAA*
```

ORF19ng-1 and ORF19-1 show 95.5% identity in 716 aa overlap:

```
                   10        20        30        40        50        60
orf19-1.pep  MKTPLLKPLLITSLPVFASVFTAASIVWQLGEPKLAMPFVLGIIAGGLVDLDNRLTGRLK
             ||||||||||||||||||||||||||||||||||||||||||||||||||||||||||||
orf19ng-1    MKTPLLKPLLITSLPVFASVFTAASIVWQLGEPKLAMPFVLGIIAGGLVDLDNRLTGRLK
                   10        20        30        40        50        60

70        80        90       100       110       120
orf19-1.pep  NIITTVALFTLSSLTAQSTLGTGLPFILAMTLMTFGFTILGAVGLKYRTFAFGALAVATY
             |||:||||||||||||||||||||||||||||||||||||||||||||||||||||||||
orf19ng-1    NIIATVALFTLSSLTAQSTLGTGLPFILAMTLMTFGFTILGAVGLKYRTFAFGALAVATY
                   70        80        90       100       110       120

130       140       150       160       170       180
orf19-1.pep  TTLTYTPETYWLTNPFMILCGTVLYSTAILLFQIVLPHRPVQESVANAYDALGGYLEAKA
             |||||||||||||||||||||||||||||||:||||:||||||||||||||:||||||||
orf19ng-1    TTLTYTPETYWLTNPFMILCGTVLYSTAIILFQIILPHRPVQESVANAYEALGGYLEAKA
                  130       140       150       160       170       180

190       200       210       220       230       240
orf19-1.pep  DFFDPDEAAWIGNRHIDLAMSNTGVITAFNQCRSALFYRLRGKHRHPRTAKMLRYYFAAQ
             ||||||||||||||||||||||||||||||||||||||||||||||||||||||||||||
orf19ng-1    DFFDPDEAAWIGNRHIDLAMSNTGVITAFNQCRSALFYRLRGKHRHPRTAKMLRYYFAAQ
                  190       200       210       220       230       240
```

```
                           -continued
                   250        260        270        280        290        300
orf19-1.pep    DIHERISSAHVDYQEMSEKFKNTDIIFRIHRLLEMQGQACRNTAQALRASKDYVYSKRLG
               ||||||||||||||||||||||||||||:|||||||||||||:|::||||||||||
orf19ng-1      DIHERISSAHVDYQEMSEKFKNTDIIFRIRRLLEMQGQACRNTAQAIRSGKDYVYSKRLG
                   250        260        270        280        290        300
                   310        320        330        340        350        360
orf19-1.pep    RAIEGCRQSLRLLSDSNDSPDIRHLRRLLDNLGSVDQQFRQLQHNGLQAENDRMGDTRIA
               |||||||||||||:|||||||||||:||||||||||||||||:|:   ||||||||||
orf19ng-1      RAIEGCRQSLRLLSDGNDSPDIRHLSRLLDNLGSVDQQFRQLRHSDSPAENDRMGDTRIA
                   310        320        330        340        350        360
                   370        380        390        400        410        420
orf19-1.pep    ALETSSLKNTWQAIRPQLNLESGVFRHAVRLSLVVAAACTIVEALNLNLGYWILLTALFV
               ||||:|:||||||||||||||| ||||||||||||||||||||||||||||||||||||
orf19ng-1      ALETGSFKNTWQAIRPQLNLESCVFRHAVRLSLVVAAACTIVEALNLNLGYWILLTALFV
                   370        380        390        400        410        420
                   430        440        450        460        470        480
orf19-1.pep    CQPNYTATKSRVRQRIAGTVLGVIVGSLVPYFTPSVETKLWIVIASTTLFFMTRTYKYSF
               |||||||||||| |||||||||||||||||||||||||||||||:|||||||||||||
orf19ng-1      CQPNYTATKSRVYQRIAGTVLGVIVGSLVPYFTPSVETKLWIVIAGTTLFFMTRTYKYSF
                   430        440        450        460        470        480
                   490        500        510        520        530        540
orf19-1.pep    STFFITIQALTSLSLAGLDVYAAMPVRIIDTIIGASLAWAAVSYLWPDWKYLTLERTAAL
               ||||||||||||||||||||||||||||||||||||||||||||||||||||||||||||
orf19ng-1      STFFITIQALTSLSLAGLDVYAAMPVRIIDTIIGASLAWAAVSYLWPDWKYLTLERTAAL
                   490        500        510        520        530        540
                   550        560        570        580        590        600
orf19-1.pep    AVCSNGAYLEKITERLKSGETGDDVEYRATRRRAHEHTAALSSTLSDMSSEPAKFADSLQ
               ||||:|:||||:|||||||||||||:|||||||||||||||||||||||||||||||||
orf19ng-1      AVCSSGTYLQKIAERLKTGETGDDIEYRITRRRAHEHTAALSSTLSDMSSEPAKFADSLQ
                   550        560        570        580        590        600
                   610        620        630        640        650        660
orf19-1.pep    PGFTLLKTGYALTGYISALGAYRSEMHEECSPDFTAQFHLAAEHTAHIFQHLPETEPDDF
               |||||||||||||||||||||||||||||||||||||||||||||||||||||:||||
orf19ng-1      PGFTLLKTGYALTGYISALGAYRSEMHEECSPDFTAQFHLAAEHTAHIFQHLPDMGPDDF
                   610        620        630        640        650        660
                   670        680        690        700        710
orf19-1.pep    QTALDTLRGELDTLRTHSSGTQSHILLQQLQLIARQLEPYYRAYRQIPHRQPQNAAX
               |||||||||||| ||||||:||||||||||||||||||||||||||||||||||||
orf19ng-1      QTALDTLRGELGTLRTRSSGTQSHILLQQLQLIARQLEPYYRAYRQIPHRQPQNAAX
                   670        680        690        700        710
```

In addition, ORF19ng-1 shows significant homology to a hypothetical gonococcal protein previously entered in the databases:

```
sp|O33369|YOR2_NEIGO HYPOTHETICAL 45.5 KD PROTEIN (ORF2) gnl|PID|e1154438
(AJ002423) hypothetical protein [Neisseria gonorrh] Length = 417
Score = 1512 (705.6 bits), Expect = 5.3e - 203, P = 5.3e - 203
Identities = 301/326 (92%), Positives = 306/326 (93%)

Query: 307 RQSLRLLSDGNDSPDIRHLRLLDNLGSVDQQFRQLRHSDSPAENDRMGDTRIAALETGS  366
           RQSLRLLSDGNDS DIRHLRLLDNLGSVDQQFRQLRHSDSPAENDRMGDTRIAALETGS
Sbjct:   1 RQSLRLLSDGNDSXDIRHLRLLDNLGSVDQQFRQLRHSDSPAENDRMGDTRIAALETGS   60

Query: 367 FKNTWQAIRPQLNLESCVFRHAVRLSLVVAAACTIVEALNLNLGYWILLTALFVCQPNYT  426
           FKNTWQAIRPQLNLES VFRHAVRLSLVVAAACTIVEALNLNLGYWILLT LFVCQPNYT
Sbjct:  61 FKNTWQAIRPQLNLESGVFRHAVRLSLVVAAACTIVEALNLNLGYWILLTRLFVCQPNYT  120

Query: 427 ATKSRVYQRIAGTVLGVIVGSLVPYFTPSVETKLWIVIAGTTLFFMTRTYKYSFSTFFIT  486
           ATKSRVYQRIAGTVLGVIVGSLVPYFTPSVETKLWIVIAGTTLFFMTRTY YSFSTFFIT
Sbjct: 121 ATKSRVYQRIAGTVLGVIVGSLVPYFTPSVETKLWIVIAGTTLFFMTRTYRYSFSTFFIT  180

Query: 487 IQALTSLSLAGLDVYAAMPVRIIDTIIGASLAWAAVSYLWPDWKYLTLERTAALAVCSSG  546
           IQALTSLSLAGLDVYAAMPVRIIDTIIGASLAWAAVSYLWPDWKYLTLERTAALAVCSSG
Sbjct: 181 IQALTSLSLAGLDVYAAMPVRIIDTIIGASLAWAAVSYLWPDWKYLTLERTAALAVCSSG  240

Query: 547 TYLQKIAERLKTGETGDDIEYRITRRRAHEHTAALSSTLSDMSSEPAKFADSLQPGFTLL  606
           TYLQKIAERLKTGETGDDIEYRITRRRAHEHTAALSSTLSDMSSEPAKFAD+  P
Sbjct: 241 TYLQKIAERLKTGETGDDIEYRITRRRAHEHTAALSSTLSDMSSEPAKFADTCNPALPCS  300
```

```
Query: 607 KTGYALTGYISALGAYRSEMHEECSP          632
            K   ALTGYISALG  ++  +  +P
Sbjct: 301 KPATALTGYISALGHTAAKCTKNAAP          326
```

Based on this analysis, including the presence of several putative transmembrane domains in the gonococcal protein (the first of which is also seen in the meningococcal protein), and on homology with the YHFK protein, it is predicted that the proteins from *N. meningitidis* and *N. gonorrhoeae*, and their epitopes, could be useful antigens for vaccines or diagnostics, or for raising antibodies.

Example 14

The following DNA sequence, believed to be complete, was identified in *N. meningitidis* <SEQ ID 113>.

```
   1 ATGAATATGC TGGGAGCTTT GGCAAAAGTC GGCAGCCTGA CGATGGTGTC
  51 GCGCGTTTTG GGATTTGTGC GCGATACGGT CATTGCGCGG GCATTCGGCG
 101 CGGGTATGGC GACGGATGCG TTTTTTGTCG CGTTCAAACT GCCCAACCTG
 151 CTTCGCCGCG TGTTTGCGGA GGGGGCGTTT GCCCAAGCGT TTGTGCCGAT
 201 TTTGGCGGAA TACAAGGAAA CGCGTTCAAA AGAGGCCG.C GAAGCCTTTA
 251 TCCGCCATGT GGCGGGGATG CTGTCGTTTG TACTGGTTAT CGTTACCGCG
 301 CTGGGCATAC TTGCCGCGCC TTGGGTGATT TATGTTTCCG CACCCgAGTT
 351 TTGCCCAAGA TGCCGACAAA TTTCAGCTCT CCATCGATTT GCTGCGGATT
 401 ACGTTTCCTT ATATATTATT GATTTCCCTG TCTTCATTTG TCGGCTCGGT
 451 ACTCAATTCT TATCATAAGT TCGGCATTCC GGCGTTTACG CCAC.GTTTC
 501 TGAACGTGTC GTTTATCGTA TTCGCGCTGT TTTTCGTGCC GTATTTCGAT
 551 CCGCCCGTTA CCGCGCyGGC GTGGGCGGTC TTTGTCGGCG GCATTTTGCA
 601 ACTCGrmTTC CAACTGCCCT GGCTGGCGAA ACTGGGCTTT TTGAAACTGC
 651 CCAAACtGAG TTTCAAAGAT GCGGCGGTCA ACCGCGTGAT GAAACAGATG
 701 GCGCCTGCgA TTTTgGGCGT GAgCGTGGCG CAGGTTTCTT TGGTGATCAA
 751 CACGATTTTc GCGTCTTATC TGCAATCGGG CAGCGTTTCA TGGATGTATT
 801 ACGCCGACCG CATGATGGAG CTGCCCAGCG GCGTGCTGGG GGCGGCACTC
 851 GGTACGATTT TGCTGCCGAC TTTGTCCAAA CACTCGGCAA ACCaAGATAC
 901 GGaACAGTTT TCCGCCCTGC TCGACTGGGG TTTGCGCCTG TGCATGCtgc
 951 TGACGCTGCC GGCGgcGGTC GGACTGGCGG TGTTGTCGTT cCCgCtGGTG
1001 GCGACGCTGT TTATGTACCG CGwATTTACG CTGTTTGACG CGCAGATGAC
1051 GCAACACGCG CTGATTGCCT ATTCTTTCGG TTTAATCGGC TTAATCATGA
1101 TTAAAGTGTT GGCACCCGGC TTCTATGCGC GGCAAAACAT CAAwAmGCCC
1151 GTCAAAATCG CCATCTTCAC GCTCATCTGC mCGCAGTTGA TGAACCTTGs
1201 CTTTAyCGGC CCACTrrAAC rCagTCGGAC TTTCGCTTGC CATCGGTCTG
1251 GGCGCGTGTA TCAATGCCGG ATTGTTGTTT TACCTGTTGC GCAGACACGG
1301 TATTTACCAA CCTGG.CAAG GGTTGGGCAG CGTTCTT.AG CAAAAATGCT
1351 GcTCTCGCTC GCCGTGA
```

This corresponds to the amino acid sequence <SEQ ID 114; ORF20>:

```
  1 MNMLGALAKV GSLTMVSRVL GFVRDTVIAR AFGAGMATDA
    FFVAFKLPNL
 51 LRRVFAEGAF AQAFVPILAE YKETRSKEAX EAFIRHVAGM
    LSFVLVIVTA
101 LGILAAPWVI YVSAPSFAQD ADKFQLSIDL LRITFPYILL
    ISLSSFVGSV
151 LNSYHKFGIP AFTPXFLNVS FIVFALFFVP YFDPPVTAXA
    WAVFVGGILQ
201 LXFQLPWLAK LGFLKLPKLS FKDAAVNRVM KQMAPAILGV
    SVAQVSLVIN
251 TIFASYLQSG SVSWMYYADR MMELPSGVLG AALGTILLPT
    LSKHSANQDT
301 EQFSALLDWG LRLCMLLTLP AAVGLAVLSF PLVATLFMYR
    XFTLFDAQMT
351 QHALIAYSFG LIGLIMIKVL APGFYARQNI XXPVKIAIFT
    LICXQLMNLX
401 FXGPLXXIGL SLAIGLGACI NAGLLFYLLR RHGIYQPXQG
    LGSVLXQKCC
451 SRSP*
```

These sequences were elaborated, and the complete DNA sequence <SEQ ID 115> is:

```
   1 ATGAATATGC TGGGAGCTTT GGCAAAAGTC GGCAGCCTGA
     CGATGGTGTC
  51 GCGCGTTTTG GGATTTGTGC GCGATACGGT CATTGCGCGG
     GCATTCGGCG
 101 CGGGTATGGC GACGGATGCG TTTTTTGTCG CGTTCAAACT
     GCCCAACCTG
 151 CTTCGCCGCG TGTTTGCGGA GGGGGCGTTT GCCCAAGCGT
     TTGTGCCGAT
 201 TTTGGCGGAA TACAAGGAAA CGCGTTCAAA AGAGGCGGCG
     GAGGCTTTTA
 251 TCCGCCATGT GGCGGGGATG CTGTCGTTTG TACTGGTTAT
     CGTTACCGCG
 301 CTGGGCATAC TTGCCGCGCC TTGGGTGATT TATGTTTCCG
     CACCCGGTTT
 351 TGCCCAAGAT GCCGACAAAT TTCAGCTCTC CATCGATTTG
     CTGCGGATTA
 401 CGTTTCCTTA TATATTATTG ATTTCCCTGT CTTCATTTGT
     CGGCTCGGTA
 451 CTCAATTCTT ATCATAAGTT CGGCATTCCG GCGTTTACGC
     CCACGTTTCT
 501 GAACGTGTCG TTTATCGTAT TCGCGCTGTT TTTCGTGCCG
     TATTTCGATC
 551 CGCCCGTTAC CGCGCTGGCG TGGGCGGTCT TTGTCGGCGG
     CATTTTGCAA
 601 CTCGGCTTCC AACTGCCCTG GCTGGCGAAA CTGGGCTTTT
     TGAAACTGCC
 651 CAAACTGAGT TTCAAAGATG CGGCGGTCAA CCGCGTGATG
     AAACAGATGG
701 CGCCTGCGAT TTTGGGCGTG AGCGTGGCGC AGGTTTCTTT
     GGTGATCAAC
 751 ACGATTTTCG CGTCTTATCT GCAATCGGGC AGCGTTTCAT
     GGATGTATTA
 801 CGCCGACCGC ATGATGGAGC TGCCCAGCGG CGTGCTGGGG
     GCGGCACTCG
 851 GTACGATTTT GCTGCCGACT TTGTCCAAAC ACTCGGCAAA
     CCAAGATACG
 901 GAACAGTTTT CCGCCCTGCT CGACTGGGGT TTGCGCCTGT
     CCATGCTGCT
 951 GACGCTGCCG GCGGCGGTCG GACTGGCGGT GTTGTCGTTC
     CCGCTGGTGG
1001 CGACGCTGTT TATGTACCGC GAATTTACGC TGTTTGACGC
     GCAGATGACG
1051 CAACACGCGC TGATTGCCTA TTCTTTCGGT TTAATCGGCT
     TAATCATGAT
1101 TAAAGTGTTG GCACCCGGCT TCTATGCGCG GCAAAACATC
     AAAACGCCCG
1151 TCAAAATCGC CATCTTCACG CTCATCTGCA CGCAGTTGAT
     GAACCTTGCC
1201 TTTATCGGCC CACTGAAACA CGTCGGACTT TCGCTTGCCA
     TCGGTCTGGG
1251 CGCGTGTATC AATGCCGGAT TGTTGTTTTA CCTGTTGCGC
     AGACACGGTA
1301 TTTACCAACC TGGCAAGGGT TGGGCAGCGT TCTTAGCAAA
     AATGCTGCTC
1351 TCGCTCGCCG TGATGTGCGG CGGACTGTGG GCAGCGCAGG
     CTTACCTGCC
1401 GTTTGAATGG GCGCACGCCG GCGGAATGCG GAAAGCGGGG
     CAGCTCTGCA
1451 TCCTGATTGC CGTCGGCGGC GGACTGTATT TCGCATCACT
     GGCGGCTTTG
1501 GGCTTCCGTC CGCGCCATTT CAAACGCGTG GAAAACTGA
```

This corresponds to the amino acid sequence <SEQ ID 116; ORF20-1>:

```
  1 MNMLGALAKV GSLTMVSRVL GFVRDTVIAR AFGAGMATDA
    FFVAFKLPNL
 51 LRRVFAEGAF AQAFVPILAE YKETRSKEAA EAFIRHVAGM
    LSFVLVIVTA
101 LGILAAPWVI YVSAPGFAQD ADKFQLSIDL LRITFPYILL
    ISLSSFVGSV
151 LNSYHKFGIP AFTPTFLNVS FIVFALFFVP YFDPPVTALA
    WAVFVGGILQ
201 LGFQLPWLAK LGFLKLPKLS FKDAAVNRVM KQMAPAILGV
    SVAQVSLVIN
251 TIFASYLQSG SVSWMYYADR MMELPSGVLG AALGTILLPT
    LSKHSANQDT
301 EQFSALLDWG LRLCMLLTLP AAVGLAVLSF PLVATLFMYR
    EFTLFDAQMT
351 QHALIAYSFG LIGLIMIKVL APGFYARQNI KTPVKIAIFT
    LICTQLMNLA
```

-continued

```
401 FIGPLKHVGL SLAIGLGACI NAGLLFYLLR RHGIYQPGKG
    WAAFLAKMLL

451 SLAVMCGGLW AAQAYLPFEW AHAGGMRKAG QLCILIAVGG
    GLYFASLAAL

501 GFRPRHFKRV EN*
```

Computer analysis of this amino acid sequence gave the following results:

Homology with the MviN Virulence Factor of *S. typhimurium* (Accession Number P37169)

ORF20 and MviN proteins show 63% aa identity in 440aa overlap:

```
Orf20   1 MNMLGALAKVGSLTMVSRVLGFVRDTVIARAFGAGMATDAFFVAFKLPNLLRRVFAEGAF   60
          MN+L +LA V S+TM SRVLGF RD ++AR FGAGMATDAFFVAFILPNLLRR+FAEGAF
MviN   14 MNLLKSLAAVSSMTMFSRVLGFARDAIVARIFGAGMATDAFFVAFKLPNLLRRIFAEGAF  73

Orf20  61 AQAFVPILAEYKETRSKEAXEAFIRHVAGMLSFVLVIVTALGILAAPWVIYVSAPSFAQD 120
          +QAFVPILAEYK + +EA F+   +V+G+L+  L +VT  G+LAAPWVI V+AP FA
MviN   74 SQAFVPILAEYKSKQGEEATRIFVAYVSGLLTLALAVVTVAGMLAAPWVIMVTAPGFADT 133

Orf20 121 ADKFQLSIDLLRITFPYILLISLSSFVGSVLNSYHKFGIPAFTPXFLNVSFIVFALFFVP 180
          ADKF L+  LLRITFPYILLISL+S VG++LN++++F IPAF P FLN+S I FALF  P
MviN  134 ADKFALTTQLLRITFPYILLISLASLVGAILNTWNRFSIPAFAPTFLNISMIGFALFAAP 193

Orf20 181 YFDPPVTAXAWAVFVGGILQLXFQLPWLAKLGFLKLPKLSFKDAAVNRVMKQMAPAILGV 240
          YF+PPV A AWAV VGG+LQL +QLP+L K+G L LP+++F+D   RV+KQM PAILGV
MviN  194 YFNPPVLALAWAVTVGGVLQLVYQLPYLKKIGMLVLPRINFRDTGAMRVVKQMGPAILGV 253

Orf20 241 SVAQVSLVINTIFASYLQSGSVSWMYYADRMMELPSGVLGAALGTILLPTLSKHSANQDT 300
          SV+Q+SL+INTIFAS+L SGSVSWMYYADR+ME PSGVLG ALGTILLP+LSK A+   +
MviN  254 SVSQISLIINTIFASFLASGSVSWMYYADRLMEFPSGVLVALGTILLPSLSKSFASGNH  313

Orf20 301 EQFSALLDWGLRLCMLLTLPAAVGLAVLSFPLVATLFMYRXFTLFDAQMTQHALIAYSFG 360
          +++  L+DWGLRLC LL LP+AV L +L+F  PL   +LF Y  FT  FDA MTQ AL1AYS G
MviN  314 DEYCRLMDWGLRLCFLLALPSAVALGILAKPLTVSLFQYGKFTAFDAAMTQRALIAYSVG 373

Orf20 361 LIGLIMIKVLAPGFYARQNIXXPVKIAIFTLICXQLMNLXFXXXXXXXXXXXXXXXXXCI 420
          LIGLI++KVLAPGFY+RQ+I   PVKIAI TLI  QLMNL F                C+
MviN  374 LIGLIVVKVLAPGFYSRQDIKTPVKIAIVTLIMTQLMNLAFIGPLKHAGLSLSIGLAACL 433

Orf20 421 NAGLLFYLLRRHGIYQPXQG                                         440
          NA LL++ LR+  I+ P G
MviN  434 NASLLYWQLRKQNIFTPQPG                                         453
```

Homology with a Predicted ORF from *N. meningitidis* (Strain A)

ORF20 shows 93.5% identity over a 447aa overlap with an ORF (ORF20a) from strain A of *N. meningitidis*:

```
                   10         20         30         40         50         60
orf20.pep  MNMLGALAKVGSLTMVSRVLGFVRDTVIARAFGAGMATDAFFVAFKLPNLLRRVFAEGAF
           ||||||:|||||||||||||||||||||||||||||||||||||||||||||||||||||
orf20a     MNMLGALVKVGSLTMVSRVLGFVRDTVIARAFGAGMATDAFFVAFKLPNLLRRVFAEGAF
                   10         20         30         40         50         60

70         80         90        100        110        120
orf20.pep  AQAFVPILAEYKETRSKEAXEAFIRHVAGMLSFVLVIVTALGILAAPWVIYVSAPSFAQD
           |||||||||||||||||||:||||||||||||||||||||||||||||||||||:||:|
orf20a     AQAFVPILAEYKETRSKEATEAFIRHVAGMLSFVLVIVTALGILAAPWVIYVSAPGFAKD
                   70         80         90        100        110        120

130        140        150        160        170        180
orf20.pep  ADKFQLSIDLLRITFPYILLISLSSFVGSVLNSYHKFGIPAFTPXFLNVSFIVFALFFVP
           ||||||||||||||||||||||||||||||||||||||:||||||:||||||||||||||
orf20a     ADKFQLSIDLLRITFPYILLISLSSFVGSVLNSYHKFSIPAFTPTFLNVSFIVFALFFVP
                  130        140        150        160        170        180

190        200        210        220        230        240
orf20.pep  YFDPPVTAXAWAVFVGGILQLXFQLPWLAKLGFLKLPKLSFKDAAVNRVMKQMAPAILGV
           ||||||||  |||||||||||| |||||||||||||||||||||||||||||||||||||
orf20a     YFDPPVTALAWAVFVGGILQLGFQLPWLAKLGFLKLPKLSFKDAAVNRVMKQMAPAILGV
                  190        200        210        220        230        240
```

```
               250        260        270        280        290        300
orf20.pep  SVAQVSLVINTIFASYLQSGSVSWMYYADRMMELPSGVLGAALGTILLPTLSKHSANQDT
           ||||:||||||||||||||||||||||||||||||||:||||||||||||||||||||||
orf20a     SVAQISLVINTIFASYLQSGSVSWMYYADRMMELPGGVLGAALGTILLPTLSKHSANQDT
               250        260        270        280        290        300
               310        320        330        340        350        360
orf20.pep  EQFSALLDWGLRLCMLLTLPAAVGLAVLSFPLVATLFMYRXFTLFDAQMTQHALIAYSFG
           ||||||||||||:|||||||||||:||||||||||||||:||||||||||||||||||||
orf20a     EQFSALLDWGLRXCMLLTLPAAVGMAVLSFPLVATLFMYREFTLFDAQMTQHALIAYSFG
               310        320        330        340        350        360
               370        380        390        400        410        420
orf20.pep  LIGLIMIKVLAPGFYARQNIXXPVKIAIFTLICXQLMNLXFXGPLXXIGLSLAIGLGACI
           ||||||||||||||||||||||:|||||||||:|||||:|||:|||::||||||||||||
orf20a     LIGLIMIKVLAPGFYARQNIKTPVKIAIFTLICTQLMNLAFIGPLKHVGLSLAIGLGACI
               370        380        390        400        410        420
               430        440        450
orf20.pep  NAGLLFYLLRRHGIYQPXQGLGSVLXQKCCSRSPX
           ||||||||||||||||||||:|::|:
orf20a     NAGLLFYLLRRHGIYQPGKGWAAFLAKMLLSLAVMGGGLYAAQIWLPFDWAHAGGMQKAA
               430        440        450        460        470        480
```

The complete length ORF20a nucleotide sequence <SEQ ID 117> is:

```
   1 ATGAATATGC TGGGAGCTTT GGTAAAAGTC GGCAGCCTGA
     CGATGGTGTC
  51 GCGCGTTTTG GGATTTGTGC GCGATACGGT CATTGCGCGC
     GCATTCGGCG
 101 CAGGCATGGC GACGGATGCG TTCTTTGTCG CGTTCAAACT
     GCCCAACCTG
 151 CTTCGCCGCG TGTTTGCGGA GGCGGCGTTT GCCCAAGCGT
     TTGTGCCGAT
 201 TTTGGCGGAA TATAAGGAAA CGCGTTCTAA AGAGGCGACG
     GAGGCTTTTA
 251 TCCGCCATGT GGCGGGGATG CTGTCGTTTG TACTGGTCAT
     CGTTACCGCG
 301 CTGGGCATAC TTGCCGCGCC TTGGGTGATT TATGTTTCCG
     CACCCGGTTT
 351 TGCCAAAGAT GCCGACAAAT TCAGCTCTC TATCGATTTG
     CTGCGGATTA
 401 CGTTTCCTTA TATCTTATTG ATTTCACTTT CCTCTTTTGT
     CCGCTCGGTA
 451 CTCAATTCCT ATCATAAATT CAGCATTCCT GCGTTTACGC
     CCACGTTCCT
 501 GAACGTGTCG TTTATCGTAT TCCCGCTGTT TTTCGTGCCG
     TATTTCGATC
 551 CTCCCGTTAC CGCGCTGGCT TGGGCGGTTT TTGTCGGCGG
     CATTTTGCAA
 601 CTCGGCTTCC AACTGCCCTG GCTGGCGAAA CTGGGTTTTT
     TGAAACTGCC
 651 CAAACTGAGT TTCAAAGATG CGGCGGTCAA CCGCGTGATG
     AAACAGATGG
 701 CGCCTGCGAT TTTGGGCGTG AGCGTGGCGC AGATTTCTTT
     GGTGATCAAC
 751 ACGATTTTCG CGTCTTATCT GCAATCGGGC AGCGTTTCAT
     GGATGTATTA
 801 CGCCGACCGC ATGATGGAAC TGCCCGGCGG CGTGCTGGGG
     GCGGCACTCG
 851 GTACGATTTT GCTGCCGACT TTGTCCAAAC ACTCGGCAAA
     CCAAGATACG
 901 GAACAGTTTT CCGCCCTGCT CGACTGGGGT TTGCGCNTGT
     GCATGCTGCT
 951 GACGCTGCCG GCGGCGGTCG GAATGGCGGT GTTGTCGTTC
     CCGCTGGTGG
1001 CAACCTTGTT TATGTACCGA GAATTCACGC TGTTTGACGC
     GCAGATGACG
1051 CAACACGCGC TGATTGCCTA TTCTTTCGGT TTAATCGGTT
     TAATCATGAT
1101 TAAAGTGTTG GCGCCCGGCT TTTATGCGCG GCAAAACATC
     AAAACGCCCG
1151 TCAAAATCGC CATCTTCACG CTCATTTGCA CGCAGTTGAT
     GAACCTTGCC
1201 TTTATCGGCC CACTGAAACA CGTCGGACTT TCGCTTGCCA
     TCGGTCTGGG
1251 CGCGTGTATC AATGCCGGAT TGTTGTTTTA CCTGTTGCGC
     AGACACGGTA
1301 TTTACCAACC TGGCAAGGGT TGGGCAGCGT TCTTGGCAAA
     AATGCTGCTC
1351 TCGCTCGCCG TGATGGGAGG CGGCCTGTAT GCCGCCCAAA
     TCTGGCTGCC
1401 GTTCGACTGG GCACACGCCG GCGGAATGCA AAAGGCCGCC
     CGGCTCTTCA
1451 TCCTGATTGC CGTCGGCGGC GGACTGTATT TCGCATCACT
     GGCGGCTTTG
1501 GGCTTCCGTC CGCGCCATTT CAAACGCGTG GAAAGCTGA
```

This encodes a protein having amino acid sequence <SEQ ID 118>:

```
   1 MNMLGALVKV GSLTMVSRVL GFVRDTVIAR AFGAGMATDA
     FFVAFKLPNL
```

-continued

```
 51 LRRVFAEGAF AQAFVPILAE YKETRSKEAT EAFIRHVAGM
    LSFVLVIVTA

101 LGILAAPWVI YVSAPGFAKD ADKFQLSIDL LRITFPYILL
    ISLSSFVGSV

151 LNSYHKFSIP AFTPTFLNVS FIVFALFFVP YFDPPVTALA
    WAVFVGGILQ

201 LGFQLPWLAK LGFLKLPKLS FKDAAVNRVM KQMAPAILGV
    SVAQISLVIN

251 TIFASYLQSG SVSWMYYADR MMELPGGVLG AALGTILLPT
    LSKHSANQDT
```

-continued

```
301 EQFSALLDWG LRXCMLLTLP AAVGMAVLSF PLVATLFMYR
    EFTLFDAQMT

351 QHALIAYSFG LIGLIMIKVL APGFYARQNI KTPVKIAIFT
    LICTQLMNLA

401 FIGPLKHVGL SLAIGLGACI NAGLLFYLLR RHGIYQPGKG
    WAAFLAKMLL

451 SLAVMGGGLY AAQIWLPFDW AHAGGMQKAA RLFILIAVGG
    GLYFASLAAL

501 GFRPRHFKRV ES*
```

ORF20a and ORF20-1 show 96.5% identity in 512 aa overlap:

```
                       10         20         30         40         50         60
orf20a.pep     MNMLGALVKVGSLTMVSRVLGFVRDTVIARAFGAGMATDAFFVAFKLPNLLRRVFAEGAF
               ||||||||:||||||||||||||||||||||||||||||||||||||||||||||||||
orf20-1        MNMLGALAKVGSLTMVSRVLGFVRDTVIARAFGAGMATDAFFVAFKLPNLLRRVFAEGAF
                       10         20         30         40         50         60

70         80         90        100        110        120
orf20a.pep     AQAFVPILAEYKETRSKEATEAFIRHVAGMLSFVLVIVTALGILAAPWVIYVSAPGFAKD
               |||||||||||||||||||:||||||||||||||||||||||||||||||||||||||:|
orf20-1        AQAFVPILAEYKETRSKEAAEAFIRHVAGMLSFVLVIVTALGILAAPWVIYVSAPGFAQD
                       70         80         90        100        110        120

130        140        150        160        170        180
orf20a.pep     ADKFQLSIDLLRITFPYILLISLSSFVGSVLNSYHKFSIPAFTPTFLNVSFIVFALFFVP
               |||||||||||||||||||||||||||||||||||||:||||||||||||||||||||||
orf20-1        ADKFQLSIDLLRITFPYILLISLSSFVGSVLNSYHKFGIPAFTPTFLNVSFIVFALFFVP
                      130        140        150        160        170        180

190        200        210        220        230        240
orf20a.pep     YFDPPVTALAWAVFVGGILQLGFQLPWLAKLGFLKLPKLSFKDAAVNRVMKQMAPAILGV
               ||||||||||||||||||||||||||||||||||||||||||||||||||||||||||||
orf20-1        YFDPPVTALAWAVFVGGILQLGFQLPWLAKLGFLKLPKLSFKDAAVNRVMKQMAPAILGV
                      190        200        210        220        230        240

250        260        270        280        290        300
orf20a.pep     SVAQISLVINTIFASYLQSGSVSWMYYADRMMELPGGVLGAALGTILLPTLSKHSANQDT
               ||||:|||||||||||||||||||||||||||||||:|||||||||||||||||||||||
orf20-1        SVAQVSLVINTIFASYLQSGSVSWMYYADRMMELPSGVLGAALGTILLPTLSKHSANQDT
                      250        260        270        280        290        300

310        320        330        340        350        360
orf20a.pep     EQFSALLDWGLRXCMLLTLPAAVGMAVLSFPLVATLFMYREFTLFDAQMTQHALIAYSFG
               ||||||||||||| ||||||||||| |||||||||||||||||||||||||||||||||
orf20-1        EQFSALLDWGLRLCMLLTLPAAVGLAVLSFPLVATLFMYREFTLFDAQMTQHALIAYSFG
                      310        320        330        340        350        360

370        380        390        400        410        420
orf20a.pep     LIGLIMIKVLAPGFYARQNIKTPVKIAIFTLICTQLMNLAFIGPLKHVGLSLAIGLGACI
               ||||||||||||||||||||||||||||||||||||||||||||||||||||||||||||
orf20-1        LIGLIMIKVLAPGFYARQNIKTPVKIAIFTLICTQLMNLAFIGPLKHVGLSLAIGLGACI
                      370        380        390        400        410        420

430        440        450        460        470        480
orf20a.pep     NAGLLFYLLRRHGIYQPGKGWAAFLAKMLLSLAVMGGGLYAAQIWLPFDWAHAGGMQKAA
               |||||||||||||||||||||||||||||||||||:|||:||||||||:||||||||:||
orf20-1        NAGLLFYLLRRHGIYQPGKGWAAFLAKMLLSLAVMCGGLWAAQAYLPFEWAHAGGMRKAG
                      430        440        450        460        470        480

490        500        510
orf20a.pep     RLFILIAVGGGLYFASLAALGFRPRHFKRVESX
               :| |||||||||||||||||||||||||||||:|
orf20-1        QLCILIAVGGGLYFASLAALGFRPRHFKRVENX
                      490        500        510
```

Homology with a Predicted ORF from *N. gonorrhoeae*

ORF20 shows 92.1% identity over a 454aa overlap with a predicted ORF (ORF20ng) from *N. gonorrhoeae*:

```
orf20.pep    MNMLGALAKVGSLTMVSRVLGFVRDTVIARAFGAGMATDAFFVAFKLPNLLRRVFAEGAF    60
             ||||||||||||||||||||||||||||||||||||||||||||||||||||||||||||
orf20ng      MNMLGALAKVGSLTMVSRVLGFVRDTVIARAFGAGMATDAFFVAFKLPNLLRRVFAEGAF    60 orf20.pep    AQAFVPILAEYKETRSKEAXEAFIRHVAGMLSFVLVIVTALGILAAPWVIYVSAPSFAQD   120
             ||||||||||||||||||| ||||||||||||||| :||||||||||||||||:|::|
orf20ng      AQAFVPILAEYKETRSKEATEAFIRHVAGMLSFVLIVVTALGILAAPWVIYVSAPGFTKD   120 orf20.pep    ADKFQLSIDLLRITFPYILLISLSSFVGSVLNSYHKFGIPAFTPXFLNVSFIVFALFFVP   180
             ||||||||:|||||||||||||||||||||:|||||||||||||:|||:|||||||||||
orf20ng      ADKFQLSISLLRITFPYILLISLSSFVGSILNSYHKFGIPAFTPTFLNISFIVFALFFVP   180 orf20.pep    YFDPPVTAXAWAVFVGGILQLXFQLPWLAKLGFLKLPKLSFKDAAVNRVMKQMAPAILGV   240
             |||||||| ||||||||||| ||||||||||||||||||: |||||||||||||||||||
orf20ng      YFDPPVTALAWAVFVGGILQLGFQLPWLAKLGFLKLPKLNFKDAAVNRVMKQMAPAILGV   240 orf20.pep    SVAQVSLVINTIFASYLQSGSVSWMYYADRMMELPSGVLGAALGTILLPTLSKHSANQDT   300
             ||||:|||||||||||||||||||||||||||||||P||||||||||||||||||||||
orf20ng      SVAQISLVINTIFASYLQSGSVSWMYYADRMMELPGGVLGAALGTILLPTLSKHSANQDT   300 orf20.pep    EQFSALLDWGLRLCMLLTLPAAVGLAVLSFPLVATLFMYRXFTLFDAQMTQHALIAYSFG   360
             |||||||||||||||||||||:||||||||||||||||| |||||||||||||||||||
orf20ng      EQFSALLDWGLRLCMLLTLPAAAGLAVLSFPLVATLFMYREFTLFDAQMTQHALIAYSFG   360 orf20.pep    LIGLIMIKVLAPGFYARQNIXXPVKIAIFTLICXQLMNLXFXGPLXXIGLSLAIGLGACI   420
             |||||||||| :|||||||| ||||||||||| ||||| | ||  ||||||||||||||
orf20ng      LIGLIMIKVLASGFYARQNIKTPVKIAIFTLICTQLMNLAFIGPLKHAGLSLAIGLGACI   420 orf20.pep    NAGLLFYLLRRHGIYQPXQGLGSVLXQKCCSRSP    454
             ||||||:|:||||:||| ||||  |:|||||||
orf20ng      NAGLLFFLFRKHGIYRPGQGLGQPSWRKCCSRSP    454
```

An ORF20ng nucleotide sequence <SEQ ID 119> was predicted to encode a protein having amino acid sequence <SEQ ID 120>:

```
  1 MNMLGALAKV GSLTMVSRVL GFVRDTVIAR AFGAGMATDA
    FFVAFKLPNL

51 LRRVFAEGAF AQAFVPILAE YKETRSKEAT EAFIRHVAGM
    LSFVLIVVTA

101 LGILAAPWVI YVSAPGFTKD ADKFQLSISL LRITFPYILL
    ISLSSFVGSI

151 LNSYHKFGIP AFTPTFLNIS FIVFALFFVP YFDPPVTALA
    WAVFVGGILQ

201 LGFQLPWLAK LGFLKLPKLN FKDAAVNRVM KQMAPAILGV
    SVAQISLVIN

251 TIFASYLQSG SVSWMYYADR MMELPGGVLG AALGTILLPT
    LSKHSANQDT

301 EQFSALLDWG LRLCMLLTLP AAAGLAVLSF PLVATLFMYR
    EFTLFDAQMT

351 QHALIAYSFG LIGLIMIKVL ASGFYARQNI KTPVKIAIFT
    LICTQLMNLA

401 FIGPLKHAGL SLAIGLGACI NAGLLFFLFR KHGIYRFGQG
    LGQPSWRKCC

451 SRSP*
```

Further DNA sequence analysis revealed the following DNA sequence <SEQ ID 121>:

```
  1 ATGAATATGC TTGGAGCTTT GGCAAAAGTC GGCAGCCTGA
    CGATGGTGTC

51 GCGCGTTTTG GGATTTGTGC GCGATACGGT CATTGCGCGG
    GCATTCGGCG

101 CGGGTATGGC GACGGATGCG TTTTTTGTCG CGTTCAAACT
    GCCCAACCTG

151 CTTCGCCGCG TGTTTGCGGA GGGGGCGTTT GCCCAAGCGT
    TTGTGCCGAT

201 TTTGGCGGAA TATAAGGAAA CGCGTTCTAA AGAGGCGAcg
    gAGGCTTTTA

251 TCCGCCACGt tgcgggAatg CTGTCGTTTG TGCTGATcgt
    cGttacCGCG

301 CTGGGCATAC TTGCCGCgcc tTGGGTGATT TATGTTtccg
    CgcccGGCTT

351 TACCAAAGAC GCGGACAAGT TCCAACTTTC CATCAGCCTG
    CTGCGGATTA

401 CGTTTCCTTA TATATTATTG ATTTCTTTGT CTTCTTTTGT
    CGGCTCGATA

451 CTCAATTCCT ACCATAAGTT CGGCATTCCC GCGTTTACGC
    CCACGTTTTT

501 AAACATCTCT TTTATCGTAT TCGCACTGTT TTTCGTGCCG
    TATTTCGATC

551 CGCCCGTTAC CGCGCTGGCG TGGGCGGTTT TTGTCGGCGG
    TATTTTGCAG

601 CTCGGTTTCC AACTGCCGTG GCTGGCGAAA CTGGGCTTTT
    TGAAACTGCC

651 CAAACTGAAT TCAAAGATG CGGCGGTCAA CCGCGTCATG
    AAACAGATGG

701 CGCCTGCGAT TTTGGGCGTG agcgTGGCGC AAATTTCTTT
    GgttATCAAC
```

-continued

```
 751 ACGATTTTCG CGTCTTATCT GCAATCGGGC AGCGTTTCAT
     GGATGTatta
 801 cgCCGACCGC ATGATCGAGc tgcgccGGGG CGTGCTGGGG
     GCTGCACTCG
 851 GTACAATTTT GCTGCCGACT TTGTCCAAAC ACTCGGCAAA
     CCAAGATACG
 901 GAACAGTTTT CCGCCCTGCT CGACTGGGGT TTGCGCCTGT
     GCATGCTGCT
 951 GACGCTGCCG GCGGCGGccg GACTGGCGGT ATTGTCGTTC
     CCGCTGGTGG
1001 CGACGCTGTT TATGTACCGA GAATTCACGC TGTTTGACGC
     ACAAATGACG
1051 CAACACGCGC TGATTGCCTA TTCTTTCGGT TTAATCGGTT
     TAATTATGAT
1101 TAAAGTGTTG GCATCCGGCT TTTATGCGCG GCAAACATC
     AAAACGCCCG
1151 TCAAAATCGC CATCTTCACG CTCATCTGCA CGCAGTTGAT
     GAACCTCGCC
1201 TTTATCGGTC CGTTGAAACA CGCCGGGCTT TCGCTCGCCA
     TCGGCCTGGG
1251 CGCGTGCATC AACGCCGGAT TGTTGTTCTT CCTGTTGCGC
     AAACACGGTA
1301 TTTACCGGCC cggcaggggt tgggcggcgt TCTTGGCGAA
     AATGCTGCTC
1351 GCGCTCGCCG TGATGTGCGG CGGACTGTGG GCGGCGCAGG
     CTTGCCTGCC
1401 GTTCGAATCG GCGCACGCCG GCGGAATGCG GAAAGCGGGG
     CAGCTCTGCA
1451 TCCTGATTGC CGTCGGCGGC GGACTGTATT TCGCATCTCT
     GGCGGCTTTG
1501 GGCTTCCGTC CGCGCCATTT CAAACGCGTG GAAAGCTGA
```

This encodes the following amino acid sequence <SEQ ID 122; ORF20ng-1>:

```
  1 MNMLGALAKV GSLTMVSRVL GFVRDTVIAR AFGAGMATDA
    FEVAFKLPNL
 51 LRRVFAEGAF AQAFVPILAE YKETRSKEAT EAFIRHVAGM
    LSFVLIVVTA
101 LGILAAPWVI YVSAPGFTKD ADKFQLSISL LRITFPYILL
    ISLSSEVGSI
151 LNSYHKFGIP AFTPTFLNIS FIVEALFFVP YFDPPVTALA
    WAVFVGGILQ
201 LGFQLPWLAK LGFLKLPKLN FKDAAVNRVM KQMAPAILGV
    SVAQISLVIN
251 TIFASYLQSG SVSWMYYADR MNELRRGVLG AALGTILLPT
    LSKHSANQDT
301 EQFSALLDWG LRLCMLLTLP AAAGLAVLSF PLVATLFMYR
    EFTLFDAQMT
351 QHALIAYSFG LIGLIMIKVL ASGFYARQNI KTPVKIAIFT
    LICTQLMNLA
401 FIGPLKHAGL SLAIGLGACI NAGLLFFLLR KHGIYRPGRG
    WAAFLAKMLL
451 ALAVMCGGLW AAQACLPFEW AHAGGMRKAG QLCILIAVGG
    GLYFASLAAL
501 GFRPRHFKRV ES*
```

ORF20ng-1 and ORF20-1 show 95.7% identity in 512 aa overlap:

```
                  10         20         30         40         50         60
orf20-1.pep   MNMLGALAKVGSLTMVSRVLGFVRDTVIARAFGAGMATDAFFVAFKLPNLLRRVFAEGAF
              ||||||||||||||||||||||||||||||||||||||||||||||||||||||||||||
orf20ng-1     MNMLGALAKVGSLTMVSRVLGFVRDTVIARAFGAGMATDAFFVAFKLPNLLRRVFAEGAF
                  10         20         30         40         50         60

70         80         90        100        110        120
orf20-1.pep   AQAFVPILAEYKETRSKEAAEAFIRHVAGMLSFVLVIVTALGILAAPWVIYVSAPGFAQD
              |||||||||||||||||||:|||||||||||||||:||||||||||||||||||||||:|
orf20ng-1     AQAFVPILAEYKETRSKEATEAFIRHVAGMLSFVLIVVTALGILAAPWVIYVSAPGFTKD
                  70         80         90        100        110        120

130        140        150        160        170        180
orf20-1.pep   ADKFQLSIDLLRITFPYILLISLSSFVGSVLNSYHKFGIPAFTPTFLNVSFIVFALFFVP
              |||||||||:||||||||||||||||:|||:||||||||||||||||||:||||||||||
orf20ng-1     ADKFQLSISLLRITFPYILLISLSSFVGSILNSYHKFGIPAFTPTFLNISFIVFALFFVP
                 130        140        150        160        170        180

190        200        210        220        230        240
orf20-1.pep   YFDPPVTALAWAVFVGGILQLGFQLPWLAKLGFLKLPKLSFKDAAVNRVMKQMAPAILGV
              |||||||||||||||||||||||||||||||||||||||:||||||||||||||||||||
orf20ng-1     YFDPPVTALAWAVFVGGILQLGFQLPWLAKLGFLKLPKLNFKDAAVNRVMKQMAPAILGV
                 190        200        210        220        230        240

250        260        270        280        290        300
orf20-1.pep   SVAQVSLVINTIFASYLQSGSVSWMYYADRMMELPSGVLGAALGTILLPTLSKHSANQDT
              ||||:|||||||||||||||||||||||||||||:|||||||||||||||||||||||||
orf20ng-1     SVAQISLVINTIFASYLQSGSVSWMYYADRMMELRRGVLGAALGTILLPTLSKHSANQDT
                 250        260        270        280        290        300

310        320        330        340        350        360
orf20-1.pep   EQFSALLDWGLRLCMLLTLPAAVGLAVLSFPLVATLFMYREFTLFDAQMTQHALIAYSFG
              |||||||||||||||||||||:||||||||||||||||||||||||||||||||||||||
orf20ng-1     EQFSALLDWGLRLCMLLTLPAAAGLAVLSFPLVATLFMYREFTLFDAQMTQHALIAYSFG
                 310        320        330        340        350        360
```

```
                  370        380        390        400        410        420
orf20-1.pep    LIGLIMIKVLAPGFYARQNIKTPVKIAIFTLICTQLMNLAFIGPLKHVGLSLAIGLGACI
               |||||||||||| ||||||||||||||||||||||||||||||:||||||||||||
orf20ng-1      LIGLIMIKVLASGFYARQNIKTPVKIAIFTLICTQLMNLAFIGPLKHAGLSLAIGLGACI
                  370        380        390        400        410        420
                  430        440        450        460        470        480
orf20-1.pep    NAGLLFYLLRRHGIYQPGKGWAAFLAKMLLSLAVMCGGLWAAQAYLPFEWAHAGGMRKAG
               ||||||:|||:||||:|:||||||||||||||:|||||||||||||| ||||||||||||
orf20ng-1      NAGLLFFLLRKHGIYRPGRGWAAFLAKMLLALAVMCGGLWAAQACLPFEWAHAGGMRKAG
                  430        440        450        460        470        480
                  490        500        510
orf20-1.pep    QLCILIAVGGGLYFASLAALGFRPRHFKRVENX
               |||||||||||||||||||||||||||||||:|
orf20ng-1      QLCILIAVGGGLYFASLAALGFRPRHFKRVESX
                  490        500        510
```

In addition, ORF20ng-1 shows significant homology with a virulence factor of *S. typhimurium*:

```
sp|P37169|MVIN_SALTY VIRULENCE FACTOR MVIN pir||S40271 mviN protein -
Salmonella typhimurium gi|438252 (Z26133) mviB gene product [Salmonella
typhimurium] gnl|PID|d1005521 (D25292) ORF2 [Salmonella typhimurium]
Length = 524 Score = 1573 (750.1 bits), Expect = 1.1e-220, Sum P(2) =
1.1e-220 Identities = 309/467 (66%), Positives = 368/467 (78%)

Query:    1 MNMLGALAKVGSLTMVSRVLGFVRDTVIARAFGAGMATDAFFVAFKLPNLLRRVFAEGAF    60
            MN+L +LA V S+TM SRVLGF RD ++AR FGAGMATDAFFVAFKLPNLLRR+FAEGAF
Sbjct:   14 MNLLKSLAAVSSMTMFSRVLGFARDAIVARIFGAGMATDAFFVAFKLPNLLRRIFAEGAF    73

Query:   61 AQAFVPILAEYKETRSKEATEAFIRHVAGMLSFVLIVVTALGILAAPWVIYVSAPGFTKD   120
            +QAFVPILAEYK  + +EAT  F+ +V+G+L+    L VVT  G+LAAPWVI V+APGF
Sbjct:   74 SQAFVPILAEYKSKQOEEATRIFVAYVSGLLTLALAVVTVAGMLAAPWVIMVTAPGFADT   133

Query:  121 ADKFQLSISLLRITFPYILLISLSSFVGSILNSYHEFGIPAFTPTFLNISFIVFALFFVP   180
            ADEF L+  LLRITFPYILLISL+S VG+ILN+++F  IPAF PTFLNIS I FALF  P
Sbjct:  134 ADKFALTTQLLRITFPYILLISLASLVGAILNTWNRFSIPAFAPTFLNISMIGFALFAAP   193

Query:  181 YFDPPVTALAWAVFVGGILQLGFQLPWLAKLGFLKLPKLNFKDAAVNRVMKQMAPAILGV   240
            YF+PPV ALAWAV VGG+LQL +QLP+L K+G L LP++NF D    RV+KQM PAILGV
Sbjct:  194 YFNPPVLALAWAVTVGGVLQLVYQLPYLKKIGMLVLPRINFRDTGAMRVVKQMGPAILGV   253

Query:  241 SVAQISLVINTIFASYLQSGSVSWMYYADRMMELRRGVLGAALGTILLPTLSKHSANQDT   300
            SV+QISL+INTIFAS+L SGSVSWMYYADR+ME   GVLG ALGTILLP+LSK A+ +
Sbjct:  254 SVSQISLIINTIFASFLASGSVSWMYYADRLMEFPSGVLCVALGTILLPSLSKSFASGNH   313

Query:  301 EQFSALLDWGLRLCMLLTLPAAAGLAVLSFPLVATLFMYREFTLFDAQMTQHALIAYSFG   360
            +++  L+DWGLRLC LL LP+A  L +L+ PL  +LF Y +FT FDA MTQ ALIAYS G
Sbjct:  314 DEYCRBMDWGLRLCFLLALPSAVALGILAKPLTVSLFQYGKFTAFDAAMTQRALIAYSVG   373

Query:  361 LIGLIMIKVLASGFYARQNIKTPVKIAIFTLICTQLMNLAFIGPLKHAGLSLAIGLGACI   420
            LIGLI++KVLA GFY+RQ+IKTPVKIAI TLI TQLMNLAFIGPLKHAGLSL+IGL AC+
Sbjct:  374 LIGLIVVKVLAPGFYSRQDIKTPVKIAIVTLIMTQLMNLAFIGPLKHAGLSLSIGLAACL   433

Query:  421 NAGLBFFLLRKHGIYRPGRGWXXXXXXXXXXXXVMCGGLWAAQACLP               467
            NA LL++ LRK I+ P GW            VM  L+    +P
Sbjct:  434 NASLLYWQLRKQNIFTPQPGWMWFLMRLIISVLVMAAVLFGVLHIMP               480

Score = 70 (33.4 bits), Expect = 1.1e-220, Sum 2(2) = 1.1e-220
Identities = 14/41 (34%), Positives = 23/41 (56%)

Query:  469 EWAHAGGMRKACQLCILIAVGGGLYFASLAALGFRPRHFKR                    509
            EW+    + +L ++ G  YFA+LA LGF+ + F R
Sbjct:  481 EWSQGSMLWRLLRLMAVVIAGIAAYFAALAVLGFKVKEFVR                    521
```

Based on this analysis, including the homology with a virulence factor from *S. typhimurium*, it is predicted that these proteins from *N. meningitidis* and *N. gonorrhoeae*, and their epitopes, could be useful antigens for vaccines or diagnostics, or for raising antibodies.

Example 15

The following partial DNA sequence was identified in *N. meningitidis* <SEQ ID 123>:

```
  1 atGATTAAAA TCAAAAAACG TCTAAACCTG CCCATCGCGG
    GCAGACCGGA

51 GCAAGCCGTT tACGACGGCC CGGCCaTTAC CGAAGtCGCG
    TTGCTTGGCG

101 AAGAATATGC CGGTATGCGC CCCTCGATGA AAGTCAAGGA
    AGGCGATGCC

151 GTcAAAAAAG GCCAAGTGCT GTTTGAAGAC AAAAAGAATC
    CGGGCGTGGT

201 GTTTACTGCG CCGGCTTCAG GcAAAATCGC CGCGATTCAC
    CGTGGCGAAA

251 AGCGCGTACT TCAGTCAGTC GTCATTGCCG TTGAArGCAA
    CGACGAAATC

301 GAGTTTGAAC GCTACGCACC TGAAGCGCTG GCAAACTTAA
    GCGGCGAAGA

351 AGTGCGCCGC AACCTGATCC AATCCGGTTT GTGGACTGCG
    CTGCGCACCC

401 GTCCGTTCAG CAAAATTCCT GCCGTCGATG CCGAGCCGTT
    CGCCATCTTC

451 GTCAATGCGA tGGACACCAA TCCG . . .
```

This corresponds to the amino acid sequence <SEQ ID 124; ORF22>:

```
  1 MIKIKKGLNL PIAGRPEQAV YDGPAITEVA LLGEEYAGMR
    PSMKVKEGDA

51 VKKGQVLFED KKNPGVVFTA PASGKIAAIH RGEKRVLQSV
    VIAVEXNDET

101 EFERYAPEAL ANLSGEEVRR NLIQSGLWTA LRTRPFSKIP
    AVDAEPFAIf

151 VNAMDTNP...
```

Further work revealed the complete nucleotide sequence <SEQ ID 125>:

```
   1 ATGATTAAAA TCAAAAAAGG TCTAAACCTG CCCATCGCGG
     GCAGACCGGA

51 GCAAGCCGTT TACGACGGCC CGGCCATTAC CGAAGTCGCG
     TTGCTTGGCG

101 AAGAATATGC CGGTATGCGC CCCTCGATGA AAGTCAAGGA
     AGGCGATGCC

151 GTCAAAAAAG GCCAAGTGCT GTTTGAAGAC AAAAAGAATC
     CGGGCGTGGT

201 GTTTACTGCG CCGGCTTCAG GCAAAATCGC CGCGATTCAC
     CGTGGCGAAA

251 AGCGCGTACT TCAGTCAGTC GTGATTGCCG TTGAAGGCAA
     CGACGAAATC
```

-continued

```
 301 GAGTTTGAAC GCTACGCACC TGAAGCGCTG GCAAACTTAA
     GCGGCGAAGA

351 AGTGCGCCGC AACCTGATCC AATCCGGTTT GTGGACTGCG
     CTGCGCACCC

401 GTCCGTTCAG CAAAATTCCT GCCGTCGATG CCGAGCCGTT
     CGCCATCTTC

451 GTCAATGCGA TGGACACCAA TCCGCTGGCT GCCGACCCTA
     CGGTCATTAT

501 CAAAGAAGCC GCCGAGGATT TCAAACGCGG CCTGTTGGTA
     TTGAGCCGTT

551 TGACCGAACG CAAAATCCAT GTTTGTAAGG CAGCTGGCGC
     AGACGTGCCG

601 TCTGAAAATG CTGCCAACAT CGAAACACAT GAATTCGGCG
     GCCCGCATCC

651 TGCCGGTTTG AGTGGCACGC ACATTCATTT CATCGAGCCG
     GTCGGCGCGA

701 ATAAAACCGT GTGGACCATC AATTATCAAG ATGTAATTAC
     CATTGGCCGT

751 TTGTTTGCAA CAGGCCGTCT GAACACCGAG CGCGTGATTG
     CCCTAGGTGG

801 TTCTCAAGTC AACAAACCGC GCCTCTTGCG TACCGTTTTG
     GGTGCGAAAG

851 TATCGCAAAT TACTGCGGGC GAATTGGTTG ACACAGACAA
     CCGCGTGATT

901 TCCGGTTCGG TATTGAACGG CGCGATTACA CAAGGCGCGC
     ACGATTATTT

951 GGGACGCTAC CACAATCAGA TTTCCGTTAT CGAAGAAGGC
     CGCAGCAAAG

1001 AGCTGTTCGG CTGGGTTGCG CCGCAGCCGG ACAAATACTC
     CATCACGCGT

1051 ACAACCCTCG GCCATTTCCT GAAAAACAAA CTCTTCAAGT
     TCAACACAGC

1101 CGTCAACGGC GGCGACCGCG CCATGGTGCC GATTGGTACT
     TACGAGCGCG

1151 TGATGCCCTT GGATATCCTG CCCACCCTGC TTTTGCGCGA
     TTTAATCGTC

1201 GGCGATACCG ACAGCGCGCA GGCATTGGGT TGCTTGGAAT
     TGGACGAAGA

1251 AGACCTCGCT TTGTGCAGCT TCGTCTGCCC GGGCAAATAC
     GAATACGGCC

1301 CGCTGTTGCG CAAAGTGCTG GAAACCATTG AGAAGGAAGG
     CTGA
```

This corresponds to the amino acid sequence <SEQ ID 126; ORF22-1>:

```
  1 MIKIKKGLNL PIAGRPEQAV YDGPAITEVA LLGEEYAGMR
    PSMKVKEGDA

51 VKKGQVLFED KKNPGVVFTA PASGKIAAIH RGEKRVLQSV
    VIAVEGNDEI

101 EFERYAPEAL ANLSGEEVRR NLIQSGLWTA LRTRPFSKIP
    AVDAEPFAIF

151 VNAMDTNPLA ADPTVIIKEA AEDFKRGLLV LSRLTERKIH
    VCKAAGADVP
```

-continued
```
201 SENAANIETH EFGGPHPAGL SGTHIHFIEP VGANKTVWTI
    NYQDVITIGR

251 LFATGRLNTE RVIALGGSQV NKPRLLRTVL GAKVSQITAG
    ELVDTDNRVI

301 SGSVLNGAIT QGAHDYLGRY HNQISVIEEG RSKELFGWVA
    PQPDKYSITR

351 TTLGHFLKNK LFKFNTAVNG GDRAMVPIGT YERVMPLDIL
    PTLLLRDLIV

401 GDTDSAQALG CLELDEEDLA LCSFVCPGKY EYGPLLRKVL
    ETIEKEG*
```

Further work identified the corresponding gene in strain A of *N. meningitidis* <SEQ ID 127>:

```
  1 ATGATTAAAA TCAAAAAAGG TCTAAACCTG CCCATCGCGG
    GCAGACCGGA

51 GCAAGTCATT TATGACGGGC CGTCATTAC CGAAGTCGCG
    TTGCTTGGCG

101 AAGAATATGC CGGTAT

```
              10        20        30        40        50        60
orf22.pep   MIKIKKGLNLPIAGRPEQAVYDGPAITEVALLGEEYAGMRPSMKVKEGDAVKKGQVLFED
            ||||||||||||||||||::||||:|||||||||||||||| ||||||||||||||||||
orf22a      MIKIKKGLNLPIAGRPEQVIYDGPVITEVALLGEEYAGMRPXMKVKEGDAVKKGQVLFED
              10        20        30        40        50        60

70        80        90       100       110       120
orf22.pep   KKNPGVVFTAPASGKIAAIHRGEKRVLQSVVIAVEXNDEIEFERYAPEALANLSGEEVRR
            || ||||||||:|||||||||||||||||||||||| ||||||||||||||||||| 
orf22a      KKXPGVVFTAPVSGKIAAIHRGEKRVLQSVVIAVEGNDEIEFERYAPEALANLSGXEXXX
              70        80        90       100       110       120

130       140       150
orf22.pep   NLIQSGLWTALRTRPFSKIPAVDAEPFAIFVNAMDTNP
            ||||||||||||:||||||||||||||||||||||||
orf22a      NLIQSGLWTALRXRPFSKIPAVDAEPFAIFVNAMDTNPLAADPVVVIKEAXXDFRRXXLV
              130       140       150       160       170       180
```

The complete strain B sequence (ORF22-1) and ORF22a show 94.9% identity in 447 aa overlap:

```
              10        20        30        40        50        60
orf22a.pep  MIKIKKGLNLPIAGRPEQVIYDGPVITEVALLGEEYAGMRPXMKVKEGDAVKKGQVLFED
            ||||||||||||||||||::||||:|||||||||||||||| ||||||||||||||||||
orf22-1     MIKIKKGLNLPIAGRPEQAVYDGPAITEVALLGEEYAGMRPSMKVKEGDAVKKGQVLFED
              10        20        30        40        50        60

70        80        90       100       110       120
orf22a.pep  KKXPGVVFTAPVSGKIAAIHRGEKRVLQSVVIAVEGNDEIEFERYAPEALANLSGXEXXX
            || ||||||||:|||||||||||||||||||||||||||||||||||||||||||| |
orf22-1     KKNPGVVFTAPASGKIAAIHRGEKRVLQSVVIAVEGNDEIEFERYAPEALANLSGEEVRR
              70        80        90       100       110       120

130       140       150       160       170       180
orf22a.pep  NLIQSGLWTALRXRPFSKIPAVDAEPFAIFVNAMDTNPLAADPVVVIKEAXXDFRRXXLV
            ||||||||||||:|||||||||||||||||||||||||||||||:|||| ||:| ||
orf22-1     NLIQSGLWTALRTRPFSKIPAVDAEPFAIFVNAMDTNPLAADPTVIIKEAAEDFKRGLLV
              130       140       150       160       170       180

190       200       210       220       230       240
orf22a.pep  LSRLTERKIHVCKAAGADVPSENAANIETHEFGGPHPAGLSGTHIHFIEPVGANKTVWTI
            ||||||||||||||||||||||||||||||||||||||||||||||||||||||||||||
orf22-1     LSRLTERKIHVCKAAGADVPSENAANIETHEFGGPHPAGLSGTHIHFIEPVGANKTVWTI
              190       200       210       220       230       240

250       260       270       280       290       300
orf22a.pep  NYQDVIAIGRLFATGRLNTERVIALGGSQVNKPRLLRTVLGAKVSQITAGELVDADNRVI
            ||||||:|||||||||||||||||||||||||||||||||||||||||||||||: |||||
orf22-1     NYQDVITIGRLFATGRLNTERVIALGGSQVNKPRLLRTVLGAKVSQITAGELVDTDNRVI
              250       260       270       280       290       300

310       320       330       340       350       360
orf22a.pep  SGSVLNGAITQGAHDYLGRYHNQISVIEEGRSKELFGWVAPQPDKYSITRTTLGHFLKNK
            ||||||||||||||||||||||||||||||||||||||||||||||||||||||||||||
orf22-1     SGSVLNGAITQGAHDYLGRYHNQISVIEEGRSKELFGWVAPQPDKYSITRTTLGHFLKNK
              310       320       330       340       350       360

370       380       390       400       410       420
orf22a.pep  LFKFTTAVNGGDRAMVPIGTYERVMPLDILPTLLLRDLIVGDTDSAQALGCLELDEEDLA
            ||||:|||||||||||||||||||||||||||||||||||||||||||||||||||||||
orf22-1     LFKFNTAVNGGDRAMVPIGTYERVMPLDILPTLLLRDLIVGDTDSAQALGCLELDEEDLA
              370       380       390       400       450       420

430       440
orf22a.pep  LCSFVCPGKYEXGPLLRKVLETXEKEGX
            |||||||||||||||||||||||| |||||
orf22-1     LCSFVCPGKYEYGPLLRKVLETIEKEGX
              430       440
```

Further work identified a partial gene sequence <SEQ ID 129> from N. gonorrhoeae, which encodes the following amino acid sequence <SEQ ID 130; ORF22ng>:

```
  1 MIKIKKGLNL PIAGRPEQVI YDGPAITEVA LLGEEYVGMR
    PSMKIKEGEA

51 VKKGQVLFED KKNPGVVFTA PASGKIAAIH RGEKRVLQSV
    VIAVEGNDEI

101 EFERYVPEAL AKLSSEKVRR NLIQSGLWTA LRTRPFSKIP
    AVDAEPFAIF

151 VNAMDTNPLA ADPTVIIKEA AEDFKRGLLV LSRLTERKIH
    VCKAAGADVP

201 SENAANIETH EFGGPHPAGL SGTHIHFIEP VGANKTVWTI
    NYQDVIAIGR

251 LFVTGRLNTE RVVALGGLQV NKPRLLRTVL GAKVSQLTAG
    ELVDADNRVI

301 SGSVLNGAIA QGAHDYLGRY HN*
```

Further work identified complete gonococcal gene <SEQ ID 131>:

```
   1 ATGATTAAAA TCAAAAAAGG TCTAAATCTG CCCATCGCGG
     GCAGACCGGA

51 GCAAGTCATT TATGACGGCC CGGCCATTAC CGAAGTCGCG
     TTGCTTGGCG

101 AAGAATATGT CGGCATGCGC CCCTCGATGA AAATCAAGGA
     AGGTGAAGCC

151 GTCAAAAAAG GCCAAGTGCT GTTTGAAGAC AAAAAGAATC
     CGGGCGTAGT

201 ATTTACTGCG CCGGCTTCAG GCAAAATCGC CGCTATTCAC
     CGTGGCGAAA

251 AGCGCGTACT TCAGTCAGTC GTGATTGCCG TTGAAGGCAA
     CGACGAAATC

301 GAGTTCGAAC GCTACGTACC TGAAGCGCTG GCAAAATTGA
     GCAGCGAAAA

351 AGTGCGCCGC AACCTGATTC AATCAGGCTT ATGGACTGCG
     CTTCGCACCC

401 GTCCGTTCAG CAAAATCCCT GCCGTAGATG CCGAGCCGTT
     CGCCATCTTC

451 GTCAATGCGA TGGACACCAA TCCGCTGGCT GCCGACCCTA
     CGGTCATCAT

501 CAAAGAAGCC GCCGAAGACT TCAAACGCGG CCTGTTGGTA
     TTGAGCCGCC

551 TGACCGAACG TAAAATCCAT GTGTGTAAAG CAGCAGGCGC
     AGACGTGCCG

601 TCTGAAAATG CTGCCAATAT CGAAACACAT CAATTTGGCG
     GCCCGCATCC

651 TGCCGGCTTG AGTGGCACGC ACATTCATTT CATCGAGCCA
     GTCGGCGCGA

701 ATAAAACCGT GTGGACCATC AATTATCAAG ACGTGATTGC
     TATCGGACGT

751 TTGTTCGTAA CAGGCCGTCT GAATACCGAG CGCGTGGTTG
     CCTTGGGCGG

801 CCTGCAAGTC AACAAACCGC GCCTCTTGCG TACCGTTTTG
     GGTGCGAAGG

851 TGTCTCAACT TACCGCCGGC GAATTGGTTG ACGCGGACAA
     CCGCGTGATT

901 TCCGGTTCGG TATTGAACGG TGCGATTGCA CAAGGCGCGC
     ATGATTATTT

951 GGGACGCTAC CACAATCAGA TTTCCGTTAT CGAAGAAGGC
     CGCAGCAAAG

1001 AGCTGTTCGG CTGGGTTGCG CCGCAGCCGG ACAAATACTC
     CATCACGCGC

1051 ACCACTCTCG GCCATTTCCT AAAAAACAAA CTCTTCAAGT
     TCACGACAGC

1101 CGTCAACGGC GGCGACCGCG CCATGGTACC GATCGGCACT
     TATGAGCGCG

1151 TAATGCCGTT GGACATCCTG CCTACCTTGC TTTTGCGCGA
     TTTAATCGTC

1201 GGCGATACCG ACAGCGCGCA GGCTTTGGGT TGCTTGGAAT
     TGGACGAAGA

1251 AGACCTCGCT TTGTGCAGCT TCGTCTGCCC GGGCAAATAC
     GAATACGGCC

1301 CGCTGTTGCG CAAAGTGCTG GAAACCATTG AGAAGGAAGG
     CTGA
```

This encodes a protein having amino acid sequence <SEQ ID 132; ORF22ng-1>:

```
  1 MIKIKKGLNL PIAGRPEQVI YDGFAITEVA LLGEEYVGMR
    PSMKIKEGEA

51 VKKGQVLFED KKNPGVVFTA PASGKIAAIH RGEKRVLQSV
    VIAVEGNDEI

101 EFERYVPEAL AKLSSEKVRR NLIQSGLWTA LRTRPFSKIP
    AVDAEPFAIF

151 VNAMDTNPLA ADPTVIIKEA AEDFKRGLLV LSRLTERKIH
    VCKAAGADVP

201 SENAANIETH EFGGPHPAGL SGTHIHFIEP VGANKTVWTI
    NYQDVIAIGR

251 LFVTGRLNTE RVVALGGLQV NKPRLLRTVL GAKVSQLTAG
    ELVDADNRVI

301 SGSVLNGAIA QGAHDYLGRY HNQISVIEEG RSKELFGWVA
    PQPDKYSITR

351 TTLGHFLKNK LFKFTTAVNG CDRAMVPIGT YERVMPLDIL
    PTLLLRDLIV

401 GDTDSAQALG CLELDEEDLA LCSFVCPGKY EYGPLLRKVL
    ETIEKEG*
```

The originally-identified partial strain B sequence (ORF22) shows 93.7% identity over a 158aa overlap with ORF22ng:

```
orf22.pep    MIKIKKGLNLPIAGRPEQAVYDGPAITEVALLGEEYAGMRPSMKVKEGDAVKKGQVLFED    60
             |||||||||||||||||::||||||||||||||||:||||||||:|||:||||||||||
orf22ng      MIKIKKGLNLPIAGRPEQVIYDGPAITEVALLGEEYVGMRPSMKIKEGEAVKKGQVLFED    60 orf22.pep    KKNPGVVFTAPASGKIAAIHRGEKRVLQSVVIAVEXNDEIEFERYAPEALANLSGEEVRR   120
             |||||||||||||||||||||||||||||||||| |||||||||:||||:||:|:|||
orf22ng      KKNPGVVFTAPASGKIAAIHRGEKRVLQSVVIAVEGNDEIEFERYVPEALAKLSSEKVRR   120 orf22.pep    NLIQSGLWTALRTRPFSKIPAVDAEPFAIFVNAMDTNP                        158
             |||||||||||||||||||||||||||||||||||||
orf22ng      NLIQSGLWTALRTRPFSKIPAVDAEPFAIFVNAMDTNPLAADPTVIIKEAAEDFKRGLLV   180
```

The complete sequences from strain B (ORF22-1) and gonococcus (ORF22ng) show 96.2% identity in 447 aa overlap:

```
                      10        20        30        40        50        60
orf22-1.pep   MIKIKKGLNLPIAGRPEQAVYDGPAITEVALLGEEYAGMRPSMKVKEGDAVKKGQVLFED
              |||||||||||||||||::||||||||||||||||:||||||||:|||:||||||||||
orf22ng-1     MIKIKKGLNLPIAGRPEQVIYDGPAITEVALLGEEYVGMRPSMKIKEGEAVKKGQVLFED
                      10        20        30        40        50        60

70        80        90       100       110       120
orf22-1.pep   KKNPGVVFTAPASGKIAAIHRGEKRVLQSVVIAVEGNDEIEFERYAPEALANLSGEEVRR
              |||||||||||||||||||||||||||||||||||||||||||||:||||:||:|:|||
orf22ng-1     KKNPGVVFTAPASGKIAAIHRGEKRVLQSVVIAVEGNDEIEFERYVPEALAKLSSEKVRR
                      70        80        90       100       110       120

130       140       150       160       170       180
orf22-1.pep   NLIQSGLWTALRTRPFSKIPAVDAEPFAIFVNAMDTNPLAADPTVIIKEAAEDFKRGLLV
              ||||||||||||||||||||||||||||||||||||||||||||||||||||||||||||
orf22ng-1     NLIQSGLWTALRTRPFSKIPAVDAEPFAIFVNAMDTNPLAADPTVIIKEAAEDFKRGLLV
                     130       140       150       160       170       180

190       200       210       220       230       240
orf22-1.pep   LSRLTERKIHVCKAAGADVPSENAANIETHEFGGPHPAGLSGTHIHFIEPVGANKTVWTI
              ||||||||||||||||||||||||||||||||||||||||||||||||||||||||||||
orf22ng-1     LSRLTERKIHVCKAAGADVPSENAANIETHEFGGPHPAGLSGTHIHFIEPVGANKTVWTI
                     190       200       210       220       230       240

250       260       270       280       290       300
orf22-1.pep   NYQDVITIGRLFATGRLNTERVIALGGSQVNKPRLLRTVLGAKVSQITAGELVDTDNRVI
              ||||||:|||||:|||||||||:|||| ||||||||||||||||||:|||||||:|||
orf22ng-1     NYQDVIAIGRLFVTGRLNTERVVALGGLQVNKPRLLRTVLGAKVSQLTAGELVDADNRVI
                     250       260       270       280       290       300

310       320       330       340       350       360
orf22-1.pep   SGSVLNGAITQGAHDYLGRYHNQISVIEEGRSKELFGWVAPQPDKYSITRTTLGHFLKNK
              |||||||||:||||||||||||||||||||||||||||||||||||||||||||||||||
orf22ng-1     SGSVLNGAIAQGAHDYLGRYHNQISVIEEGRSKELFGWVAPQPDKYSITRTTLGHFLKNK
                     310       320       330       340       350       360

370       380       390       400       410       420
orf22-1.pep   LFKFNTAVNGGDRAMVPIGTYERVMPLDILPTLLLRDLIVGDTDSAQALGCLELDEEDLA
              ||||:|||||||||||||||||||||||||||||||||||||||||||||||||||||||
orf22ng-1     LFKFTTAVNGGDRAMVPIGTYERVMPLDILPTLLLRDLIVGDTDSAQALGCLELDEEDLA
                     370       380       390       400       410       420

430       440
orf22-1.pep   LCSFVCPGKYEYGPLLRKVLETIEKEGX
              ||||||||||||||||||||||||||||
orf22ng-1     LCSFVCPGKYEYGPLLRKVLETIEKEGX
                     430       440
```

Computer analysis of these sequences gave the following results:

Homology with 48 kDa Outer Membrane Protein of *Actinobacillus pleuropneumoniae* (Accession Number U24492).
ORF22 and this 48 kDa protein show 72% aa identity in 158aa overlap:

```
Orf22    1 MIKIKKGLNLPIAGRPEQAVYDGPAITEVALLGEEYAGMRPSMKVKEGDAVKKGQVLFED   60
           MI IKKGL+LPIAG P Q +++G  + EVA+LGEEY GMRPSMKV+EGD VKKGQVLFED
48kDa    1 MITIKKGLDLPIAGTPAQVIHNGNTVNEVAMLGEEYVGMRPSMKVREGDVVKKGQVLFED   60 orf22   61 KKNPGVVFTAPASGKIAAIHRGEKRVLQSVVIAVEXNDEIEFERYAPEALANLSGEEVRR  120
           KKNPGVVFTAPASG +  I+RGEKRVLQSVVI VE +++I F RY     LA+LS E+V++
48kDa   61 KKNPGVVFTAPASGTVVTINRGEKRVLQSVVIKVEGDEQITFTRYEAAQLASLSAEQVKQ  120 orf22  121 NLIQSGLWTALRTRPFSKIPAVDAEPFAIFVNAMDTNP                       158
           NLI+SGLWTA RTRPFSK+PA+DA P +IFVNAMDTNP
48kDa  121 NLIESGLWTAFRTRPFSKVPALDAIPSSIFVNAMDTNP                       158
```

ORF22a also shows homology to the 48 kDa *Actinobacillus pleuropneumoniae* protein:

```
gi|1185395 (U24492) 48 kDa outer membrane protein
[Actinobacillus pleuropneumoniae] Length = 449

Score = 530 bits (1351), Expect = e - 150
Identities = 274/450 (60%), Positives = 323/450 (70%), Gaps = 4/450 (0%)

Query:   1 MIKIKKGLNLPIAGRPEQVIYDGPVITEVALLGEEYAGMRPXMKVKEGDAVKKGQVLFED   60
           MI IKKGL+LPIAG P QVI++G  + EVA+LGEEY GMRP MKV+EGD VKKGQVLFED
Sbjct:   1 MITIKKGLDLPIAGTPAQVIHNGNTVNEVAMLGEEYVGMRPSMKVREGDVVKKGQVLFED   60

Query:  61 KKXPGVVFTAPVSGKIAAIHRGEKRVLQSVVIAVEGNDEIEFERYAPEALANLSGXEXXX  120
           KK PGVVFTAP SG +  I+RGEKRVLQSVVI VEG+++I F RY     LA+LS  +
Sbjct:  61 KKNPGVVFTAPASGTVVTINRGEKRVLQSVVIKVEGDEQITFTRYEAAQLASLSAEQVKQ  120

Query: 121 NLIQSGLWTALRXRPFSKIPAVDAEPFAIFVNAMDTNPLAADPVVVIKEAXXDFRRXXLv  180
           NLI+SGLWTA R RPFSK+PA+DA P +IFVNAMDTNPLAADP VV+KE    DF+     V
Sbjct: 121 NLIESGLWTAFRTRPFSKVPALDAIPSSIFVNAMDTNPLAADPEVVLKEYETDFKDGLTV  180

Query: 181 LSRL--TERKIHVCKAAGADVP-SENAANIETHEFGGPHPAGLSGTHIHFIEPVGANKTV  237
           L+RL  ++ +++CK A +++P S     I     F G HPAGL GTHIHF++PVGA K V
Sbjct: 181 LTRLFNGQKPVYLCKDADSNIPLSPAIEGITIKSFSGVHPAGLVGTHIHFVDPVGATKQV  240

Query: 238 WTINYQDVIAIGRLFATGRLNTERVIALGGSQVNKPRLLRTVLGAKVSQITAGELVDADN  297
           W +NYQDVIAIG+LF TG L T+R+I+L G QV  PRL+RT LGA +SQ+TA EL   +N
Sbjct: 241 WHLNYQDVIAIGKLFTTGELFTDRIISLAGPQVKNPRLVRTRLGANLSQLTANELNAGEN  300

Query: 298 RVISGSVLNGAITQGAHDYLGRYHNQISVIEEGRSKELFGWVAPQPDKYSITRTTLGHFL  357
           RVISGSVL+GA   G  DYLGRY Q+SV+ EGR KELFGW+ P  DK+SITRT LGHF
Sbjct: 301 RVISGSVLSGATAAGPVDYLGRYALQVSVLAEGREKELFGWIMPGSDKFSITRTVLGHFG  360

Query: 358 KNKLFKFTTAVNGGDRAMVPIGTYERVMXXXXXXXXXXXXXXVGDTDSAQXXXXXXXXXX  417
           K KLF FTTAV+GG+RAMVPIG YERVM              GDTDSAQ
Sbjct: 361 K-KLFNFTTAVHGGERAMVPIGAYERVMPLDIIPTLLLRDLAAGDTDSAQNLGCLELDEE  419

Query: 418 XXXXXSFVCPGKYEXGPLLRKVLETXEKEG                               447
                ++VCPGK   GP+LR  LE  EKEG
```

ORF22ng-1 also shows homology with the OMP from *A. pleuropneumoniae*:

```
gi|1185395 (U24492) 48 kDa outer membrane protein [Actinobacillus
pleuropneumoniae] Length = 449
Score = 555 bits (1414), Expect = e - 157
Identities = 284/450 (63%), Positives = 337/450 (74%), Gaps = 4/450 (0%)

Query:  27 MIKIKKGLNLPIAGRPEQVIYDGPAITEVALLGEEYVGMRPSMKIKEGEAVKKGQVLFED   86
           MI IKKGL+LPIAG P QVI++G  + EVA+LGEEYVGMRPSMK++EG+ VKKGQVLFED
Sbjct:   1 MITIKKGLDLPIAGTPAQVIHNGNTVNEVAMLGEEYVGMRPSMKVREGDVVKKGQVLFED   60
```

-continued

```
Query:   87 KKNPGVVFTAPASGKIAAIHRGEKRVLQSVVIAVEGNDEIEFERYVPEALAKLSSEKVRR 146
            KKNPGVVFTAPASG +I+RGEKRVLQSVVI VEG+++I F RY    LA LS+E+V++
Sbjct:   61 KKNPGVVFTAPASGTVVTINRGEKRVLQSVVIKVEGDEQITFTRYEAAQLASLSAEQVKQ 120

Query:  147 NLIQSGLWTALRTRPFSKIPAVDAEPFAIFVNAMDTNPLAADPTVIIKEAAEDFKRGLLV 206
            NLI+SGLWTA RTRPFSK+PA+DA P +IFVNAMDTNPLAADP V++KE   DFK GL V
Sbjct:  121 NLIESGLWTAFRTRPFSKVPALDAIPSSIFVNANDTNPLAADPEVVLKEYETDFKDGLTV 180

Query:  207 LSRL--TERKIHVCKAAGADVP-SENAANIETHEFGGPHPAGLSGTHIHFIEPVGANKTV 263
            L+RL   ++ +++CK A +++P S    I    F G HPAGL GTHIHF++PVGA K V
Sbjct:  181 LTRLFNGQKPVYLCKDADSNIPLSPAIEGITIKSFSGVHPAGLVGTHIHFVDPVGATKQV 240

Query:  264 WTINYQDVIAIGRLFVTGRLNTERVVALGGLQVNKPRLLRTVLGAKVSQLTAGELVDADN 323
            W +NYQDVIAIG+LF TG L T+R+++L G QV PRL+RT LGA +SQLTA EL   +N
Sbjct:  241 WHLNYQDVIAIGKLFTTGELFTDRIISLAGPQVKNPRLVRTRLGANLSQLTANELNAGEN 300

Query:  324 RVISGSVLNGAIAQGAHDYLGRYHNQISVIEEGRSKELFGWVAPQPDKYSITRTTLGHFL 383
            RVISGSVL+GA A G  DYLGRY  Q+SV+ EGR KELFGW+ P  DK+SITRT LGHF
Sbjct:  301 RVISGSVLSGATAAGPVDYLGRYALQVSVLAEGREKELFGWIMPGSDKFSITRTVLGHFG 360

Query:  384 KNKLFKFTTAVNGGDRAMVPIGTYERVMXXXXXXXXXXXXXXXVGDTDSAQXXXXXXXXXX 443
            K KLF FTTAV+GG+RAMVPIG YERVM               GDTDSAQ
Sbjct:  361 K-KLFNFTTAVHGGERAMVPIGAYERVMPLDIIPTLLLRDLAAGDTDSAQNLGCLELDEE 419

Query:  444 XXXXXSFVCPGKYEYGPLLRKVLETIEKEG 473
                 ++VCPGK YGP+LR  LE IEKEG
Sbjct:  420 DLALCTYVCPGKNNYGPMLRAALEKIEKEG 449
```

Based on this analysis, including the homology with the outer membrane protein of *Actinobacillus pleuropneumoniae*, it was predicted that these proteins from *N. meningitidis* and *N. gonorrhoeae*, and their epitopes, could be useful antigens for vaccines or diagnostics, or for raising antibodies.

ORF22-1 (35.4 kDa) was cloned in pET and pGex vectors and expressed in *E. coli*, as described above. The products of protein expression and purification were analyzed by SDS-PAGE. FIG. 5A shows the results of affinity purification of the GST-fusion protein, and FIG. 5B shows the results of expression of the His-fusion in *E. coli*. Purified GST-fusion protein was used to immunise mice, whose sera were used for ELISA (positive result) and FACS analysis (FIG. 5C). These experiments confirm that ORF22-1 is a surface-exposed protein, and that it is a useful immunogen.

Example 16

The following partial DNA sequence was identified in *N. meningitidis* <SEQ ID 133>:

```
  1 ..GCGnCGnAAA TCATCCATCC CC..nACGTC GTAGGCCCTG AAGCCAACTG
 51   GTTTTTTATG GTAGCCAGTA CGTTTGTGAT TGCTTTGATT GGTTATTTTG
101   TTACTGAAAA AATCGTCGAA CCGCAATTGG GCCCTTATCA ATCAGATTTG
151   TCACAAGAAG AAAAAGACAT TCCGCATTCC AATGAAATCA CGCCTTTGGA
201   ATATAAAGGA TTAATTTGGG CTGGCGTGGT GTTTGTTGCC TTATCCGCCC
251   TATTGGCTTG GAGCATCGTC CCTGCCGACG GTATTTTGCG TCATCCTGAA
301   ACAGGATTGG TTTCCGGTTC GCCGTTTTTA AAATCGATTG TTGTTTTTAT
351   TTTCTTGTTG TTTGCACTGC CGGGCATTGT TTATGGCCGG GTAACCCGAA
401   GTTTGCGCGG CGAACAGGAA GTCGTTAATG CGmyGGCCGA ATCGATGAGT
451   ACTCTGGsGC TTTmTTTGsw CAkcATCTTT TTTGCCGCAC AGTTTGTCGC
501   ATTTTTTAAT TGGACGAATA TTGGGCAATA TATTGCCGTT AAAGGGGCGA
551   CGTTCTTAAA AGAAGTCGGC TTGGGCGGCA GCGTGTTGTT TATCGGTTTT
601   ATTTTAATTT GTGCTTTTAT CAATCTGATG ATAGGCTCCG CCTCCGCGCA
651   ATGGGCGGTA ACTGCGCCGA TTTTCGTCCC TATGCTGATG TTGGCCGGCT
701   ACGCGCCCGA AGTCATTCAA GCCGCTTACC GCATCGGTGA TTCCGTTACC
751   AATATTATTA CGCCGATGAT GAGTTATTTC GGGCTGATTA TGGCGACGGT
```

```
801   GrkCmmmTAC AAAAAAGATG CGGGCGTGGG TaCGcTGATT wCTATGATGT

851   TGCCGTATTC CGCTTTCTTC TTGATTGCgT GGATTGCCTT ATTCTGCATT

901   TGGGTATTTg TTTTGGGCCT GCCCGTCGGT CCCGGCGCGC CCACATTCTA

951   TCCCGCACCT TAA
```

This corresponds to the amino acid sequence <SEQ ID 134; ORF12>:

```
  1   ..AXXIIHPXXV VGPEANWFFM VASTFVIALI GYFVTEKIVE PQLGPYQSDL

51   SQEEKDIRHS NEITPLEYKG LIWAGVVFVA LSALLAWSIV PADGILRHPE

101   TGLVSGSPFL KSIVVFIFLL FALPGIVYGR VTRSLRGEQE VVNAXAESMS

151   TLXLXLXXIF FAAQFVAFFN WTNIGQYIAV KGATFLKEVG LGGSVLFIGF

201   ILICAFINLM IGSASAQWAV TAPIFVPMLM LAGYAPEVIQ AAYRIGDSVT

251   NIITPMMSYF GLIMATVXXY KKDAGVGTLI XMMLPYSAFF LIAWIALFCI

301   WVFVLGLPVG PGAPTFYPAP *
```

Further sequence analysis revealed the complete DNA sequence <SEQ ID 135> to be:

```
   1 ATGAGTCAAA CCGATACGCA ACGGGACGGA CGATTTTTAC GCACAGTCGA

51 ATGGCTGGGC AATATGTTGC CGCATCCGGT TACGCTTTTT ATTATTTTCA

101 TTGTGTTATT GCTGATTGCC TCTGCCGTCG GTGCGTATTT CGGACTATCC

151 GTCCCCGATC CGCGCCCTGT TGGTGCGAAA GGACGTGCCG ATGACGGTTT

201 GATTTACATT GTCAGCCTGC TCAATGCCGA CGGTTTTATC AAAATCCTGA

251 CGCATACCGT TAAAAATTTC ACCGGTTTCG CGCCGTTGGG AACGGTGTTG

301 GTTTCTTTAT TGGGCGTGGG GATTGCGGAA AAATCGGGCT TGATTTCCGC

351 ATTAATGCGC TTATTGCTCA CAAAATCGCC ACGCAAACTC ACTACTTTTA

401 TGGTTGTTTT TACAGGGATT TTATCTAATA CCGCTTCTGA ATTGGGCTAT

451 GTCGTCCTAA TCCCTTTGTC CGCCATCATC TTTCATTCCC TCGGCCGCCA

501 TCCGCTTGCC GGTCTGGCTG CGGCTTTCGC CGGCGTTTCG GGCGGTTATT

551 CGGCCAATCT GTTCTTAGGC ACAATCGATC CGCTCTTGGC AGGCATCACC

601 CAACAGGCGG CGCAAATCAT CCATCCCGAC TACGTCGTAG GCCCTGAAGC

651 CAACTGGTTT TTTATGGTAG CCAGTACGTT TGTGATTGCT TTGATTGGTT

701 ATTTTGTTAC TGAAAAAATC GTCGAACCGC AATTGGGCCC TTATCAATCA

751 GATTTGTCAC AAGAAGAAAA AGACATTCGG CATTCCAATG AAATCACGCC

801 TTTGGAATAT AAAGGATTAA TTTGGGCTGG CGTGGTGTTT GTTGCCTTAT

851 CCGCCCTATT GGCTTGGAGC ATCGTCCCTG CCGACGGTAT TTTGCGTCAT

901 CCTGAAACAG GATTGGTTTC CGGTTCGCCG TTTTTAAAAT CGATTGTTGT

951 TTTTATTTTC TTGTTGTTTG CACTGCCGGG CATTGTTTAT GGCCGGGTAA

1001 CCCGAAGTTT GCGCGGCGAA CAGGAAGTCG TTAATGCGAT GGCCGAATCG

1051 ATGAGTACTC TGGGGCTTTA TTTGGTCATC ATCTTTTTTG CCGCACAGTT
```

```
-continued
1101 TGTCGCATTT TTTAATTGGA CGAATATTGG GCAATATATT GCCGTTAAAG

1151 GGGCGACGTT CTTAAAAGAA GTCGGCTTGG GCGGCAGCGT GTTGTTTATC

1201 GGTTTTATTT TAATTTGTGC TTTTATCAAT CTGATGATAG GCTCCGCCTC

1251 CGCGCAATGG GCGGTAACTG CGCCGATTTT CGTCCCTATG CTGATGTTGG

1301 CCGGCTACGC GCCCGAAGTC ATTCAAGCCG CTTACCGCAT CGGTGATTCC

1351 GTTACCAATA TTATTACGCC GATGATGAGT TATTTCGGGC TGATTATGGC

1401 GACGGTGATC AAATACAAAA AAGATGCGGG CGTGGGTACG CTGATTTCTA

1451 TGATGTTGCC GTATTCCGCT TTCTTCTTGA TTGCGTGGAT TGCCTTATTC

1501 TGCATTTGGG TATTTGTTTT GGGCCTGCCC GTCGGTCCCG GCGCGCCCAC

1551 ATTCTATCCC GCACCTTAA
```

This corresponds to the amino acid sequence <SEQ ID 136; ORF12-1>:

```
  1 MSQTDTQRDG RFLRTVEWLG NMLPHPVTLF IIFIVLLLIA SAVGAYFGLS

51 VPDPRPVGAK GRADDGLIYI VSLLNADGFI KILTHTVKNF TGFAPLGTVL

101 VSLLGVGIAE KSGLISALMR LLLTKSPRKL TTFMVVFTGI LSNTASELGY

151 VVLIPLSAII FHSLGRHPLA GLAAAFAGVS GGYSANLFLG TIDPLLAGIT

201 QQAAQIIHPD YVVGPEANWF FMVASTFVIA LIGYFVTEKI VEPQLGPYQS

251 DLSQEEKDIR HSNEITPLEY KGLIWAGVVF VALSALLAWS IVPADGILRH

301 PETGLVSGSP FLKSIVVFIF LLFALPGIVY GRVTRSLRGE QEVVNAMAES

351 MSTLGLYLVI IFFAAQFVAF FNWTNIGQYI AVKGATFLKE VGLGGSVLFI

401 GFILICAFIN LMIGSASAQW AVTAPIFVPM LMLAGYAPEV IQAAYRIGDS

451 VTNIITPMMS YFGLIMATVI KYKKDAGVGT LISMMLPYSA FFLIAWIALF

501 CIWVFVLGLP VGPGAPTFYP AP*
```

Computer analysis of this amino acid sequence gave the following results:

Homology with a Predicted ORF from *N. meningitidis* (Strain A)

ORF12 shows 96.3% identity over a 320aa overlap with an ORF (ORF12a) from strain A of *N. meningitidis*:

```
                                        10         20         30
orf12.pep                        AXXIIHPXXVVGPEANWFFMVASTFVIALI
                                 |   ||||  ||||||||||||||||||||
orf12a     AAAFAGVSGGYSANLFLGTIDPLLAGITQQAAQIIHPDYVVGPEANWFFMVASTFVIALI
                180        190        200        210        220        230

40         50         60         70         80         90
orf12.pep   GYFVTEKIVEPQLGPYQSDLSQEEKDIRHSNEITPLEYKGLIWAGVVFVALSALLAWSIV
            ||||||||||||||||||||||||||||||||||||||||||||||||||||||||||||
orf12a      GYFVTEKIVEPQLGPYQSDLSQEEKDIRHSNEITPLEYKGLIWAGVVFVALSALLAWSIV
                240        250        260        270        280        290

100        110        120        130        140        150
orf12.pep   PADGILRHPETGLVSGSPFLKSIVVFIFLLFALPGIVYGRVTRSLRGEQEVVNAXAESMS
            ||||||||||||||||||||||||||||||||||||||||||||||||||||||||||||
orf12a      PADGILRHPETGLVSGSPFLKSIVVFIFLLFALPGIVYGRVTRSLRGEQEVVNAXAESMS
                300        310        320        330        340        350
```

```
                        160        170        180        190        200        210
orf12.pep    TLXLXLXXIFFAAQFVAFFNWTNIGQYIAVKGATFLKEVGLGGSVLFIGFILICAFINLM
             ||  |  |||||||||||||||||||||||||||||||||||||||||||||||||||||
orf12a       TLGLYLVIIFFAAQFVAFFNWTNIGQYIAVKGATFLKEVGLGGSVLFIGFILICAFINLM
                        360        370        380        390        400        410

220        230        240        250        260        270
orf12.pep    IGSASAQWAVTAPIFVPMLMLAGYAPEVIQAAYRIGDSVTNIITPMMSYFGLIMATVXXY
             |||||||||||||||||||||||||||||||||||||||||||||||||||||||||  |
orf12a       IGSASAQWAVTAPIFVPMLMLAGYAPEVIQAAYRIGDSVTNIITPMMSYFGLIMATVIKY
                        420        430        440        450        460        470

280        290        300        310        320
orf12.pep    KKDAGVGTLIXMMLPYSAFFLIAWIALFCIWVFVLGLPVGPGAPTFYPAPX
             ||||||||||| |||||||||||||||||||||||||||||||||||||||
orf12a       KKDAGVGTLISMMLPYSAFFLIAWIALFCIWVFVLGLPVGPGAPTFYPAPX
                        480        490        500        510        520
```

The complete length ORF12a nucleotide sequence <SEQ ID 137> is:

```
   1 ATGAGTCAAA CCGATACGCA ACGGGACGGA CGATTTTTAC GCACAGTCGA
  51 ATGGCTGGGC AATATGTTGC CGCACCCGGT TACGCTTTTT ATTATTTTCA
 101 TTGTGTTATT GCTGATTGCC TCTGCCGCCG GTGCGTATTT CGGACTATCC
 151 GTCCCCGATC CGCGCCCTGT TGGTGCGAAA GGACGTGCCG ATGACGGTTT
 201 GATTCACGTT GTCAGCCTGC TCGATGCTGA CGGTTTGATC AAAATCCTGA
 251 CGCATACCGT TAAAAATTTC ACCGGTTTCG CCCGTTGGG AACGGTGTTG
 301 GTTTCTTTAT TGGGCGTGGG CATTGCGGAA AAATCGGGCT TGATTTCCGC
 351 ATTAATGCGC TTATTGCTCA CAAAATCTCC ACGCAAACTC ACTACTTTTA
 401 TGGTTGTTTT TACAGGGATT TTATCTAATA CCGCTTCTGA ATTGGGCTAT
 451 GTCGTCCTAA TCCCTTTGTC CGCCATCATC TTTCATTCCC TCGGCCGCCA
 501 TCCGCTTGCC GGTCTGGCTG CGGCTTTCGC CGGCGTTTCG CGCGGTTATT
 551 CGGCCAATCT GTTCTTAGGC ACAATCGATC CGCTCTTGGC AGGCATCACC
 601 CAACAGGCGG CGCAAATCAT CCATCCCGAC TACGTCGTAG CCCTGAAGC
 651 CAACTGGTTT TTTATGGTAG CCAGTACGTT TGTGATTGCT TGATTGGTT
 701 ATTTTGTTAC TGAAAAAATC GTCGAACCGC AATTGGGCCC TTATCAATCA
 751 GATTTGTCAC AAGAAGAAAA AGACATTCGA CATTCCAATG AAATCACGCC
 801 TTTGGAATAT AAAGGATTAA TTTGGGCTGG CGTGGTGTTT GTTGCCTTAT
 851 CCGCCCTATT GGCTTGGAGC ATCGTCCCTG CCGACGGTAT TTTGCGTCAT
 901 CCTGAAACAG GATTGGTTTC CGGTTCGCCG TTTTTAAAAT CAATTGTTGT
 951 TTTTATTTTC TTGTTGTTTG CACTGCCGGG CATTGTTTAT GGCCGGGTAA
1001 CCCGAAGTTT GCGCGGCGAA CAGGAAGTCG TTAATGCGAT GGCCGAATCG
1051 ATGAGTACTC TGGGGCTTTA TTTGGTCATC ATCTTTTTTG CCGCACAGTT
1101 TGTCGCATTT TTTAATTGGA CGAATATTGG CAATATATT GCCGTTAAAG
1151 GGGCGACGTT CTTAAAAGAA GTCGGCTTGG GCGGCAGCGT GTTGTTTATC
1201 GGTTTTATTT TAATTTGTGC TTTTATCAAT CTGATGATAG CTCCGCCTC
1251 CGCGCAATGG GCGGTAACTG CGCCGATTTT CGTCCCTATG CTGATGTTGG
1301 CCGGCTACGC GCCCGAAGTC ATTCAAGCCG CTTACCGCAT CGGTGATTCC
```

```
1351 GTTACCAATA TTATTACGCC GATGATGAGT TATTTCGGGC TGATTATGGC

1401 GACGGTGATC AAATACAAAA AAGATGCGGG CGTGGGTACG CTGATTTCTA

1451 TGATGTTGCC GTATTCCGCT TTCTTCTTGA TTGCGTGGAT TGCCTTATTC

1501 TGCATTTGGG TATTTGTTTT GGGCCTGCCC GTCGGTCCCG GCGCGCCCAC

1551 ATTCTATCCC GCACCTTAA
```

This encodes a protein having amino acid sequence <SEQ ID 138>:

```
  1 MSQTDTQRDG RFLRTVEWLG NMLPHPVTLF IIFIVLLLIA SAAGAYFGLS

51 VPDPRPVGAK GRADDGLIHV VSLLDADGLI KILTHTVKNF TGFAPLGTVL

101 VSLLGVGIAE KSGLISALMR LLLTKSPRKL TTFMVVFTGI LSNTASELGY

151 VVLIPLSAII FHSLGRHPLA GLAAAFAGVS GGYSANLFLG TIDPLLAGIT

201 QQAAQIIHPD YVVGPEANWF FMVASTFVIA LIGYFVTEKI VEPQLGPYQS

251 DLSQEEKDIR HSNEITPLEY KGLIWAGVVF VALSALLAWS IVPADGILRH

301 PETGLVSGSP FLKSIVVFIF LLFALPGIVY GRVTRSLRGE QEVVNAMAES

351 MSTLGLYLVI IFFAAQFVAF FNWTNIGQYI AVKGATFLKE VGLGGSVLFI

401 GFILICAFIN LMIGSASAQW AVTAPIFVPM LMLAGYAPEV IQAAYRIGDS

451 VTNIITPMMS YFGLIMATVI KYKKDAGVGT LISMMLPYSA FFLIAWIALF

501 CIWVFVLGLP VGPGAPTFYP AP*
```

ORF12a and ORF12-1 show 99.0% identity in 522 aa overlap:

```
                   10        20        30        40        50        60
orf12a.pep  MSQTDTQRDGRFLRTVEWLGNMLPHPVTLFIIFIVLLLIASAAGAYFGLSVPDPRPVGAK
            ||||||||||||||||||||||||||||||||||||||||:|||||||||||||||||||
orf12-1     MSQTDTQRDGRFLRTVEWLGNMLPHPVTLFIIFIVLLLIASAVGAYFGLSVPDPRPVGAK
                   10        20        30        40        50        60

70        80        90       100       110       120
orf12a.pep  GRADDGLIHVVSLLDADGLIKILTHTVKNFTGFAPLGTVLVSLLGVGIAEKSGLISALMR
            ||||||||::||||:|||:|||||||||||||||||||||||||||||||||||||||||
orf12-1     GRADDGLIYIVSLLNADGFIKILTHTVKNFTGFAPLGTVLVSLLGVGIAEKSGLISALMR
                   70        80        90       100       110       120

130       140       150       160       170       180
orf12a.pep  LLLTKSPRKLTTFMVVFTGILSNTASELGYVVLIPLSAIIFHSLGRHPLAGLAAAFAGVS
            ||||||||||||||||||||||||||||||||||||||||||||||||||||||||||||
orf12-1     LLLTKSPRKLTTFMVVFTGILSNTASELGYVVLIPLSAIIFHSLGRHPLAGLAAAFAGVS
                  130       140       150       160       170       180

190       200       210       220       230       240
orf12a.pep  GGYSANLFLGTIDPLLAGITQQAAQIIHPDYVVGPEANWFFMVASTFVIALIGYFVTEKI
            ||||||||||||||||||||||||||||||||||||||||||||||||||||||||||||
orf12-1     GGYSANLFLGTIDPLLAGITQQAAQIIHPDYVVGPEANWFFMVASTFVIALIGYFVTEKI
                  190       200       210       220       230       240

250       260       270       280       290       300
orf12a.pep  VEPQLGPYQSDLSQEEKDIRHSNEITPLEYKGLIWAGVVFVALSALLAWSIVPADGILRH
            ||||||||||||||||||||||||||||||||||||||||||||||||||||||||||||
orf12-1     VEPQLGPYQSDLSQEEKDIRHSNEITPLEYKGLIWAGVVFVALSALLAWSIVPADGILRH
                  250       260       270       280       290       300
```

```
                        310        320        330        340        350        360
orf12a.pep    PETGLVSGSPPFLKSIVVFIFLLFALPGIVYGRVTRSLRGEQEVVNAMAESMSTLGLYLVI
              ||||||||||||||||||||||||||||||||||||||||||||||||||||||||||||
orf12-1       PETGLVSGSPPFLKSIVVFIFLLFALPGIVYGRVTRSLRGEQEVVNAMAESMSTLGLYLVI
                        310        320        330        340        350        360
                        370        380        390        400        410        420
orf12a.pep    IFFAAQFVAFFNWTNIGQYIAVKGATFLKEVGLGGSVLFIGFILICAFINLMIGSASAQW
              ||||||||||||||||||||||||||||||||||||||||||||||||||||||||||||
orf12-1       IFFAAQFVAFFNWTNIGQYIAVKGATFLKEVGLGGSVLFIGFILICAFINLMIGSASAQW
                        370        380        390        400        410        420
                        430        440        450        460        470        480
orf12a.pep    AVTAPIFVPMLMLAGYAPEVIQAAYRIGDSVTNIITPMMSYFGLIMATVIKYKKDAGVGT
              ||||||||||||||||||||||||||||||||||||||||||||||||||||||||||||
orf12-1       AVTAPIFVPMLMLAGYAPEVIQAAYRIGDSVTNIITPMMSYFGLIMATVIKYKKDAGVGT
                        430        440        450        460        470        480
                        490        500        510        530
orf12a.pep    LISMMLPYSAFFLIAWIALFCIWVFVLGLPVGPGAPTFYPAPX
              |||||||||||||||||||||||||||||||||||||||||||
orf12-1       LISMMLPYSAFFLIAWIALFCIWVFVLGLPVGPGAPTFYPAPX
                        490        500        510        530
```

Homology with a Predicted ORF from *N. gonorrhoeae*

ORF12 shows 92.5% identity over a 320aa overlap with a predicted ORF (ORF12.ng) from *N. gonorrhoeae*:

```
orf12.pep                                   AXXIIHPXXVVGPEANWFFMVASTFVIALI    30
                                            |  ||||  ||||||||||||:|||||||||
orf12ng       AAAFAGVSGGYSANLFLGTIDPLLAGITQQAAQIIHPDYVVGPEANWFFMAASTFVIALI   232
orf12.pep     GYFVTEKIVEPQLGPYQSDLSQEEKDIRHSNEITPLEYKGLIWAGVVFVALSALLAWSIV    90
              ||||||||||||||||||||||||||||||||||||||||||||||||||||||||||||
orf12ng       GYFVTEKIVEPQLGPYQSDLSQEEKDIRHSNEITPLEYKGLIWAGVVFVALSALLAWSIV   292
orf12.pep     PADGILRHPETGLVSGSPFLKSIVVFIFLLFALPGIVYGRVTRSLRGEQEVVNAXAESMS   150
              ||||||||||||:||||||||||||||||||||||||||:||||||||||:||||||||
orf12ng       PADGILRHPETGLVAGSPFLKSIVVFIFLLFALPGIVYGRITRSLRGEREVVNAMAESMS   352
orf12.pep     TLXLXLXXIFFAAQFVAFFNWTNIGQYIAVKGATFLKEVGLGGSVLFIGFILICAFINLM   210
              || |  ||||||||||||||||||||||||||:|||:||||||||||||||||||||||
orf12ng       TLGLYLVIIFFAAQFVAFFNWTNIGQYIAVKGAVFLKKFRLGGSVLFIGFILICAFINLM   412
orf12.pep     IGSASAQWAVTAPIFVPMLMLAGYAPEVIQAAYRIGDSVTNIITPMMSYFGLIMATVXXY   270
              |||||||||||||||||||||||||:|||||||||||||||||||||||||||||| |
orf12ng       IGSASAQWAVTAPIFVPMLMLAGNAPQVIQAAYRIGDSVTNIITPMMSYFGLIMATVIKY   472
orf12.pep     KKDAGVGTLIXMMLPYSAFFLIAWIALFCIWVFVLGLPVGPGAPTFYPAP            320
              |||||||||| |||||||||||||||||||||||||||||:|||||:|
orf12ng       KKDAGVGTLISMMLPYSAFFLIAWIALFCIWVFVLGLPVGPGTPTFYPVP            522
```

The complete length ORF12ng nucleotide sequence <SEQ ID 139> is:

```
  1 ATGAGTCAAA CCGACGCGCG TCGTAGCGGA CGATTTTTAC GCACAGTCGA

51 ATGGCTGGGC AATATGTTGC CGCACCCGGT TACGCTTTTT ATTATTTTCA

101 TTGTGTTATT GCTGATTGcc tctgCCGTCG GTGCGTATTT CGGACTATCC

151 GTCCCCGATC CGCGTCCTGT TGGGGCGAAA GGACGTGCCG ATGACGGTTT

201 GATTCACGTT GTCAGCCTGC TCGATGCCGA CGGTTTGATC AAAATCCTGA

251 CGCATACCGT TAAAAATTTC ACCGGTTTCG CGCCGTTGGG AACGGTGTTG

301 GTTTCTTTAT TGGGCGTGGG GATTGCGGAA AAATCGGGCT TGATTTCCGC

351 ATTAATGCGC TTATTGCTCA CAAAATCCCC ACGCAAACTC ACTACTTTTA
```

```
-continued
 401 TGGTTGTTTT TACAGGGATT TTATCCAATA CGGCTTCTGA ATTGGGCTAT

451 GTCGTCCTAA TCCCTTTGTC CGCCGTCATC TTTCATTCGC TCGGCCGCCA

501 TCCGCTTGCC GGTTTGGCTG CGGCTTTCGC CGGCGTTTCG GGCGGTTATT

551 CGGCCAATCT GTTCTTAGGC ACAATCGATC CGCTCTTGGC AGGCATCACC

601 CAACAGGCGG CGCAAATCAT CCATCCCGAC TACGTCGTAG CCCTGAAGC

651 CAACTGGTTT TTTATGGCAG CCAGTACGTT TGTGATTGCT TTGATTGGTT

701 ATTTTGTTAC TGAAAAAATC GTCGAACCGC AATTGGGCCC TTATCAATCA

751 GATTTGTCAC AAGAAGAAAA AGACATTCGG CATTCCAATG AAATCACGCC

801 TTTGGAATAT AAAGGATTAA TTTGGGCAGG CGTGGTGTTT GTTGCCTTAT

851 CCGCCCTATT GGCTTGGAGC ATCGTCCCTG CCGACGGTAT TTTGCGTCAT

901 CCTGAAACAG GATTGGTTGC CGGTTCGCCG TTTTTAAAAT CGATTGTTGT

951 TTTTATTTTC TTGTTGTTTG CGCTGCCGGG CATTGTTTAT GGCCGGATAA

1001 CCCGAAGTTT GCGCGGCGAA CGGGAAGTCG TTAATGCGAT GGCCGAATCG

1051 ATGAGTACTT TGGGACTTTA TTTGGTCATC ATCTTTTTTG CCGCACAGTT

1101 TGTCGCATTT TTTAATTGGA CGAATATTGG GCAATATATT GCCGTTAAAG

1151 GGGCGGTGTT CTTAAAAGAA GTCGGCTTGG GCGGCAGTGT GTTGTTTATC

1201 GGTTTTATTT TAATTTGTGC TTTTATCAAT CTGATGATAG GCTCCGCCTC

1251 CGCGCAATGG GCGGTAACTG CGCCGATTTT CGTCCCTATG CTGATGTTGG

1301 CCGGCTACGC GCCCGAAGTC ATTCAAGCCG CTTACCGCAT CGGTGATTCC

1351 GTTACCAATA TTATTACGCC GATGATGAGT TATTTCGGGC TGATTATGGC

1401 GACGGTAATC AAATACAAAA AGATGCGGG CGTAGGCACG CTGATTTCTA

1451 TGATGTTGCC GTATTCCGCT TTCTTCTTAA TTGCATGGAT CGCCTTATTC

1501 TGCATTTGGG TATTTGTTTT GGGTCTGCCC GTCGGTCCCG GCACACCCAC

1551 ATTCTATCCG GTGCCTTAA
```

This encodes a protein having amino acid sequence <SEQ ID 140>:

```
  1 MSQTDARRSG RFLRTVEWLG NMLPHPVTLF IIFIVLLLIA SAVGAYFGLS

51 VPDPRPVGAK GRADDGLIHV VSLLDADGLI KILTHTVKNF TGFAPLGTVL

101 VSLLGVGIAE KSGLISALMR LLLTKSPRKL TTFMVVFTGI LSNTASELGY

151 VVLIPLSAVI FHSLGRHPLA GLAAAFAGVS GGYSANLFLG TIDPLLAGIT

201 QQAAQIIHPD YVVGPEANWF FMAASTFVIA LIGYFVTEKI VEPQLGPYQS

251 DLSQEEKDIR HSNEITPLEY KGLIWAGVVF VALSALLAWS IVPADGILRH

301 PETGLVAGSP FLKSIVVFIF LLFALPGIVY GRITRSLRGE REVVNAMAES

351 MSTLGLYLVI IFFAAQFVAF FNWTNIGQYI AVKGAVFLKK FRLGGSVLFI

401 GFILICAFIN LMIGSASAQW AVTAPIFVPM LMLAGNAPQV IQAAYRIGDS

451 VTNIITPMMS YFGLIMATVI KYKKDAGVGT LISMMLPYSA FFLIAWIALF

501 CIWVFVLGLP VGPGTPTFYP VP*
```

ORF12ng shows 97.1% identity in 522 aa overlap with ORF12-1:

```
                        10         20         30         40         50         60
      orf12-1.pep   MSQTDTQRDGRFLRTVEWLGNMLPHPVTLFIIFIVLLLIASAVGAYFGLSVPDPRPVGAK
                    |||||::|:|||||||||||||||||||||||||||||||||||||||||||||||||||
      orf12ng       MSQTDARRSGRFLRTVEWLGNMLPHPVTLFIIFIVLLLIASAVGAYFGLSVPDPRPVGAK
                        10         20         30         40         50         60
                        70         80         90        100        110        120
      orf12-1.pep   GRADDGLIYIVSLLNADGFIKILTHTVKNFTGFAPLGTVLVSLLGVGIAEKSGLISALMR
                    ||||||||:||||:|||:||||||||||||||||||||||||||||||||||||||||||
      orf12ng       GRADDGLIHVVSLLDADGLIKILTHTVKNFTGFAPLGTVLVSLLGVGIAEKSGLISALMR
                        70         80         90        100        110        120
                       130        140        150        160        170        180
      orf12-1.pep   LLLTKSPRKLTTFMVVFTGILSNTASELGYVVLIPLSAIIFHSLGRHPLAGLAAAFAGVS
                    |||||||||||||||||||||||||||||||||||||:||||||||||||||||||||||
      orf12ng       LLLTKSPRKLTTFMVVFTGILSNTASELGYVVLIPLSAVIFHSLGRHPLAGLAAAFAGVS
                       130        140        150        160        170        180
                       190        200        210        220        230        240
      orf12-1.pep   GGYSANLFLGTIDPLLAGITQQAAQIIHPDYVVGPEANWFFMVASTFVIALIGYFVTEKI
                    |||||||||||||||||||||||||||||||||||||||:||||||||||||||||||||
      orf12ng       GGYSANLFLGTIDPLLAGITQQAAQIIHPDYVVGPEANWFFMAASTFVIALIGYFVTEKI
                       190        200        210        220        230        240
                       250        260        270        280        290        300
      orf12-1.pep   VEPQLGPYQSDLSQEEKDIRHSNEITPLEYKGLIWAGVVFVALSALLAWSIVPADGILRH
                    ||||||||||||||||||||||||||||||||||||||||||||||||||||||||||||
      orf12ng       VEPQLGPYQSDLSQEEKDIRHSNEITPLEYKGLIWAGVVFVALSALLAWSIVPADGILRH
                       250        260        270        280        290        300
                       310        320        330        340        350        360
      orf12-1.pep   PETGLVSGSPFLKSIVVFIFLLFALPGIVYGRVTRSLRGEQEVVNAMAESMSTLGLYLVI
                    |||||:||||||||||||||||||||||||||:||||||:||||||||||||||||||||
      orf12ng       PETGLVAGSPFLKSIVVFIFLLFALPGIVYGRITRSLRGEREVVNAMAESMSTLGLYLVI
                       310        320        330        340        350        360
                       370        380        390        400        410        420
      orf12-1.pep   IFFAAQFVAFFNWTNIGQYIAVKGATFLKEVGLGGSVLFIGFILICAFINLMIGSASAQW
                    ||||||||||||||||||||||||||:|||||||||||||||||||||||||||||||||
      orf12ng       IFFAAQFVAFFNWTNIGQYIAVKGAVFLKEVGLGGSVLFIGFILICAFINLMIGSASAQW
                       370        380        390        400        410        420
                       430        440        450        460        470        480
      orf12-1.pep   AVTAPIFVPMLMLAGYAPEVIQAAYRIGDSVTNIITPMMSYFGLIMATVIKYKKDAGVGT
                    ||||||||||||||||||||||||||||||||||||||||||||||||||||||||||||
      orf12ng       AVTAPIFVPMLMLAGYAPEVIQAAYRIGDSVTNIITPMMSYFGLIMATVIKYKKDAGVGT
                       430        440        450        460        470        480
                       490        500        510        530
      orf12-1.pep   LISMMLPYSAFFLIAWIALFCIWVFVLGLPVGPGAPTFYPAPX
                    |||||||||||||||||||||||||||||||||||:||||:||
      orf12ng       LISMMLPYSAFFLIAWIALFCIWVFVLGLPVGPGTPTFYPVPX
                       490        500        510        530
```

In addition, ORF12ng shows significant homology with a hypotehtical protein from *E. coli*:

```
sp|P46133|YDAH_ECOLI HYPOTHETICAL 55.1 KD PROTEIN IN OGT-DBPA
INTERGENIC REGION >gi|1787597 (AE000231) hypothetical protein
in ogt 5'region [Escherichia coli]

Length = 510
Score = 329 bits (835), Expect = 2e-89
Identities = 178/507 (35%), Positives = 281/507 (55%), Gaps = 15/507 (2%)

Query:   8  RSGRFLRTVEWLGNMLPHPVTXXXXXXXXXXXASAVGAYFGLSVPDPRPVGAKGRADDGL    67
            +SG+    VE +GN  PHP              +A+ + FG+S  +P        D
Sbjct:  13  QSGKLYGWVERIGNKVPHPFLLFIYLIIVLMVTTAILSAFGVSAKNP--------TDGTP   64

Query:  68  IHVVSLLDADGLIKILTHTVKNFTGFAPXXXXXXXXXXXXIAEKSGLISALMRLLLTKSP   127
            + V +LL  +GL    L  +  +KNF+GFAP            +AE+ GL+ ALM + +
Sbjct:  65  VVVKNLLSVEGLHWFLPNVIKNFSGFAPLGAILALVLGAGLAERVGLLPALMVKMASHVN  124
```

```
Query: 128  RKLTTFMVVFTGILSNTASELGYVVLIPLSAVIFHSLGRHPLAGLAAAFAGVSGGYSANL  187
            +  ++MV+F     S+ +S+    V++ P+ A+IF ++GRHP+AGL AA AGV  G++ANL
Sbjct: 125  ARYASYMVLFIAFFSHISSDAALVIMPPMGALIFLAVGRHPVAGLLAAIAGVGCGFTANL  184

Query: 188  FLGTIDPLLAGITQQAAQIIHPDYVVGPEANWFFMAASTFVIALIGYFVTEKIVEPQLGP  247
            + T D LL+GI+ +AA   +P  V      NW+FMA+S  V+ ++G +T+KI+EP+LG
Sbjct: 185  LIVTTDVLLSGISTEAAAAFNPQMHVSVIDNWYFMASSVVVLTIVGGLITDKIIEPRLGQ  244

Query: 248  YQSDLSQEEKDIRHSNEITPLEYKGLIWAGVVFVALSALLAWSIVPADGILRHPETGLVA  307
            +Q +  ++ + + S         GL  AGVV +  A +A ++P +GILR P     V
Sbjct: 245  WQGNSDEKLQTLTESQRF------GLRIAGVVSLLFIAAIALMVIPQNGILRDPINHTVM  298

Query: 308  GSPFLKSIVVFIFLLFALPGIVYGRITRSLRGEREVVNAMAESMSTLGLYLXXXXXXXXX  367
             SPF+K IV   I L F +   + YG  TR++R + ++ + M E M    +      ++
Sbjct: 299  PSPFIKGIVPLIILFFFVVSLAYGIATRTIRRQADLPHLMIEPMKEMAGFIVMVFPLAQF  358

Query: 368  XXXXNWTNIGQYIAVKGAVFLKEVGLGGSVLFIGFILICAFINLMIGSASAQWAVTAPIF  427
                NW+N+C++IAV     L+  GL G   F+G  L+ +F+ +  I S  SA W++ APIF
Sbjct: 359  VAMFNWSNMGKFIAVGLTDILESSGLSGIPAFVGLALLSSFLCMFIASGSAIWSILAPIF  418

Query: 428  VPMLMLAGYAPEVIQAAYRIGDSVTNIITPMMSYFGLIMATVIKYKKDAGVGTLISMMLP  487
            VPN ML G+  P    Q  +RI DS    + P+  +  L +  + +YK DA +GT  S++LP
Sbjct: 419  VPMFMLLGFHPAFAQILFRIADSSVLPLAPVSPFVPLFLGFLQRYKPDAKLGTYYSLVLP  478

Query: 488  YSAFFLIAWIALFCIWVFVLGLPVGPG                                 514
            Y    FL+ W+ +     W +++GLP+GPG
Sbjct: 479  YPLIFLVVWLLMLLAW-YLVGLPIGPG                                 504
```

Based on this analysis, including the presence of several putative transmembrane domains and the predicted actinin-type actin-binding domain signature (shown in bold) in the gonococcal protein, it is predicted that the proteins from *N. meningitidis* and *N. gonorrhoeae*, and their epitopes, could be useful antigens for vaccines or diagnostics, or for raising antibodies.

Example 17

The following partial DNA sequence was identified in *N. meningitidis* <SEQ ID 141>:

```
  1  ..ACAGCCGGCG CAGCAGGTTn CnCGGTCTTC GTTTTCGTAA CGGACAGTCA
 51    GGTGGAGGTG TTCGGGAACA TCCAGACCGC AGTGGAAACA GGTTTTTTTC
101    ATGGCATTTC GGTTTCGTCT GTGTTTGGTG CGGCGGCACA AGACTCGGCA
151    ATgGCTTCGC GCAGTGCGTC TATACCGGTA TTTTCAGCAA CGGAAATGCG
201    GACGGcGgCA ATTTTTCCCG CAGCGTCGCG CCATATGCCC GTGTTTTgTT
251    CTTCAGACGG CAGCAGGTCG GTTTTGTTGT ACACCTTgAT GCACGGAaTA
301    TCGCCGGCAT GGATTTCTTG CAGTACGTTT TCCACGTCTT CAATCTGCTG
351    TCCGCTGTTC GGAGCGGCGG CATCGACGAC GTGCAGCAGC ACATCgGcTT
401    gCGCGGTTTC TTCCAGCGTG GCgGAAAAGG CGGAAATCAG TTTgTGCGGC
451    agATyGCTnA CGAATCCGAC GGTATCGGTC AGGATAATGC TGCATTCGGG
501    ACT..
```

This corresponds to the amino acid sequence <SEQ ID 142; ORF14>:

```
  1  ..TAGAAGXXVF VFVTDSQVEV FGNIQTAVET GFFHGISVSS VFGAAAQDSA

51    MASRSASIPV FSATEMRTAA IFPAASRHMP VFCSSDGSRS VLLYTLMHGI

101    SPAWISCSTF STSSICCPLF GAAASTTCSS TSACAVSSSV AEKAEISLCG

151    RXLTNPTVSV RIMLHSG..
```

Computer analysis of this amino acid sequence gave the following results:

Homology with a Predicted ORF from *N. meningitidis* (Strain A)

ORF14 shows 94.0% identity over a 167aa overlap with an ORF (ORF14a) from strain A of *N. meningitidis*:

```
                                          10         20         30
  orf14.pep                       TAGAAGXXVFVFVTDSQVEVFGNIQTAVET
                                  |:||||  ||||||||:|::||||:| ||||
  orf14a      GRQLGFLRVGGALFVITAQARVNNALCDCLTTGAAGFAVFVFVTDGQMQVFGNVQPAVET
                   150       160       170       180       190       200
                    40         50         60         70         80         90
  orf14.pep   GFFHGISVSSVFGAAAQDSAMASRSASIPVFSATEMRTAAIFPAASRHMPVFCSSDGSRS
              |||||||||||||||||| |||||||||||||||||||||||||||||||||||||||||
  orf14a      GFFHGISVSSVFGAAAQYSAMASRSASIPVFSATEMRTAAIFPAASRHMPVFCSSDGSRS
                   210       220       230       240       250       260
                   100        110        120        130        140        150
  orf14.pep   VLLYTLMHGISPAWISCSTFSTSSICCPLFGAAASTTCSSTSACAVSSSVAEKAEISLCG
              ||||||||||||||||||||||||||||||||||||||||||||||||||||||||||||
  orf14a      VLLYTLMHGISPAWISCSTFSTSSICCPLFGAAASTTCSSTSACAVSSSVAEKAEISLCG
                   270       280       290       300       310       320
                   160
  orf14.pep   RXLTNPTVSVRIMLHSG
              | |||||||||||||||
  orf14a      RSLTNPTVSVRIMLHSGLMYSRRAVVSSVAKSWSFAYMPDLVSRLNRLDLPTLVX
                   330       340       350       360       370       380
```

The complete length ORF14a nucleotide sequence <SEQ ID 143> is:

```
  1 ATGGAGGATT TGCAGGAAAT CGGGTTCGAT GTCGCCGCCG TAAAGGTAGG

51 TCGGCAGCGC GAACATCATC GTCTGCATCA TCCCCAGCCC GGCAACGGCG

101 AGGCGGACGA TGTATTGTTT GCGTTCTTTT TGGTTGGCGG CTTCGATTTT

151 TTGCGCGTCA TAGGGTGCGG CGGTGTAGCC TATCTGCCTG ATTTTCAACA

201 GAATGTCGGA AAGGCGGATT TTGCCGTCGT CCCAGACGAC GCGGCAGCGG

251 TGCGTGCTGT AATTGAGGTC GATGCGGACG ATGCCGTCTG TACGCAAAAG

301 CTGCTGTTCG ATCAGCCAGA CGCAGGCGGC GCAGGTGATG CCGCCGAGCA

351 TTAAAACCGC CTCGCGCGTG CCGCCGTGGG TTTCCACAAA GTCGGACTGG

401 ACTTCGGGCA GGTCGTACAG GCGGATTTGG TCGAGGATTT CTTGGGGCGG

451 CAGCTCGGTT TTTTGCGCGT CGGCGGTGCG TTGTTTGTAA TAACTGCCCA

501 AGCCCGCGTC AATAATGCTT TGTGCGACTG CCTGACAACC GGCGCAGCAG

551 GTTTCGCGGT CTTCGTTTTC GTAACGGACG GTCAGATGCA GGTTTTCGGG

601 AACGTCCAGC CCGCAGTGGA AACAGGTTTT TTTCATGGCA TTTCGGTTTC
```

-continued

```
 651 GTCTGTGTTT GGTGCGGCGG CACAATACTC GGCAATGGCT TCGCGCAGTG
 701 CGTCTATACC GGTATTTTCA GCAACGGAAA TGCGGACGGC GGCAATTTTT
 751 CCCGCAGCGT CGCGCCATAT GCCCGTGTTT TGTTCTTCAG ACGGCAGCAG
 801 GTCGGTTTTG TTGTACACCT TGATGCACGG AATATCGCCG GCATGGATTT
 851 CTTGCAGTAC GTTTTCCACG TCTTCAATCT GCTGTCCGCT GTTCGGAGCG
 901 GCGGCATCGA CGACGTGCAG CAGCACATCG GCTTGCGCGG TTTCTTCCAG
 951 CGTGGCGGAA AAGGCGGAAA TCAGTTTGTG CGGCAGATCG CTGACGAATC
1001 CGACGGTATC GGTCAGGATA ATGCTGCATT CGGGACTGAT GTACAGCCGC
1051 CGCGCCGTCG TGTCGAGTGT GGCGAAAAGC TGGTCTTTCG CATATATGCC
1101 CGACTTGGTC AGCCGGTTGA ACAGACTGGA TTTGCCGACA TTGGTATAG
```

This encodes a protein having amino acid sequence <SEQ ID 144>:

```
  1 MEDLQEIGFD VAAVKVGRQR EHHRLHHPQP GNGEADDVLF AFFLVGGFDF
 51 LRVIGCGGVA YLPDFQQNVG KADFAVVPDD AAAVRAVIEV DADDAVCTQK
101 LLFDQPDAGG AGDAAEH*NR LARAAVGFHK VGLDFGQVVQ ADLVEDFLGR
151 QLGFLRVGGA LFVITAQARV NNALCDCLTT GAAGFAVFVF VTDGQMQVFG
201 NVQPAVETGF FHGISVSSVF GAAAQYSAMA SRSASIPVFS ATEMRTAAIF
251 PAASRHMPVF CSSDGSRSVL LYTLMHGISP AWISCSTFST SSICCPLFGA
301 AASTTCSSTS ACAVSSSVAE KAEISLCGRS LTNPTVSVRI MLHSGLMYSR
351 RAVVSSVAKS WSFAYMPDLV SRLNRLDLPT LV*
```

It should be noted that this sequence includes a stop codon at position 118.

Homology with a Predicted ORF from *N. gonorrhoeae*

ORF14 shows 89.8% identity over a 167aa overlap with a predicted ORF (ORF14.ng) from *N. gonorrhoeae*:

```
orf14.pep                        TAGAAGXXVFVFVTDSQVEVFGNIQTAVET    30
                                 ||  |||   ||:||:|:|::||||:| ||||
orf14ng    GRQFGFFRVGGASFVITAQAGIDDALCDCLTADAAGFAVFAFVADGQMQVFGNVQPAVET   208 orf14.pep  GFFHGISVSSVFGAAAQDSAMASRSASIPVFSATEMRTAAIFPAASRHMPVFCSSDGSRS    90
           |||||||||||||||||| |||||||||||||||||||||||||||||||||||||||||
orf14ng    GFFHGISVSSVFGAAAQYSAMASRSASIPVFSATEMRTAAIFPAASRHMPVFCSSDGSRS   268 orf14.pep  VLLYTLMHGISPAWISCSTFSTSSICCPLFGAAASTTCSSTSACAVSSSVAEKAEISLCG   150
           |||||||||||| ||||||||||||||||||| |||||||||| :|||:||||||||||
orf14ng    VLLYTLMHGISWAWISCSTFSTSSICCPLFRAAASTTCSSTSACTVSSKVAEKAEISLCG   328 orf14.pep  RXLTNPTVSVRIMLHSG                                             167
           | |||||||||||||:|
orf14ng    RSLTNPTVSVRIMLHAGLMYSRRAVVSSVAKSWSFAYMPDLVSRLNRLDLPTLVX       382
```

The complete length ORF14ng nucleotide sequence <SEQ ID 145> is predicted to encode a protein having amino acid sequence <SEQ ID 146>:

```
  1 MEDLQEIGFD VAAVKVGRQR EHHRLHHTQS GNGKADDVLF AFFLVGGFDF
 51 LRVIGCGGVA CLPDFQQNVG EADFAVVPDD AAAVRAVIEV DADDAVCAQK
101 LLFDQPDAGG AGNAAEHQHC FVRAIMGFHK VGLDFGQVVQ ADLVEDFLGR
151 QFGFFRVGGA SFVITAQAGI DDALCDCLTA DAAGFAVFAF VADGQMQVFG
201 NVQPAVETGF FHGISVSSVF GAAAQYSAMA SRSASIPVFS ATEMRTAAIF
251 PAASRHMPVF CSSDGSRSVL LYTLMHGISW AWISCSTFST SSICCPLFRA
301 AASTTCSSTS ACTVSSKVAE KAEISLCGRS LTNPTVSVRI MLHAGLMYSR
351 RAVVSRVAKS WSFAYMPDLV SRLNRLDLPT LV*
```

Based on the putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 18

The following partial DNA sequence was identified in *N. meningitidis* <SEQ ID 147>:

```
  1 ..GGCCATTACT CCGACCGCAC TTGGAAGCCG CGTTTGGNCG GCCGCCGTCT
 51 GCCGTATCTG CTTTATGGCA CGCTGATTGC GGTTATTGTG ATGATTTTGA
101 TGCCGAACTC GGGCAGCTTC GGTTTCGGCT ATGCGTCGCT GGCGGCTTTG
151 TCGTTCGGCG CGCTGATGAT TGCGCTGTTA GACGTGTCGT CAAATATGGC
201 GATGCAGCCG TTTAAGATGA TGGTCGGCGA CATGGTCAAC GAGGAGCAGA
251 AAA.NTACGC CTACGGGATT CAAAGTTTCT TAGCAAATAC GGGCGCGGTC
301 GTGGCGGCGA TTCTGCCGTT TGTGTTTGCG TATATCGGTT TGGCGAACAC
351 CGCCGANAAA GGCGTTGTGC CGCAGACCGT GGTCGTGGCG TTTTATGTGG
401 GTGCGGCGTT GCTGGTGATT ACCAGCGCGT TCACGATTTT CAAAGTGAAG
451 GAATACGANC CGGAAACCTA CGCCCGTTAC CACGGCATCG ATGTCGCCGC
501 GAATCAGGAA AAAGCCAACT GGATCGCACT CTTAAAA.CC GCGC..
```

This corresponds to the amino acid sequence <SEQ ID 148; ORF16>:

```
  1 ..GHYSDRTWKP RLXGRRLPYL LYGTLIAVIV MILMPNSGSF GFGYASLAAL
 51 SFGALMIALL DVSSNMAMQP FKMMVGDMVN EEQKXYAYGI QSFLANTGAV
101 VAAILPFVFA YIGLANTAXK GVVPQTVVVA FYVGAALLVI TSAFTIFKVK
151 EYXPETYARY HGIDVAANQE KANWIALLKX A..
```

Further work revealed the complete nucleotide sequence <SEQ ID 149>:

```
   1 ATGTCGGAAT ATACGCCTCA AACAGCAAAA CAAGGTTTGC CCGCGCTGGC
  51 AAAAAGCACG ATTTGGATGC TCAGTTTCGG CTTTCTCGGC GTTCAGACGG
 101 CCTTTACCCT GCAAAGCTCG CAAATGAGCC GCATTTTTCA AACGCTAGGC
 151 GCAGACCCGC ACAATTTGGG CTGGTTTTTC ATCCTGCCGC CGCTGGCGGG
 201 GATGCTGGTG CAGCCGATTG TCGGCCATTA CTCCGACCGC ACTTGGAAGC
 251 CGCGTTTGGG CGGCCGCCGT GTGCCGTATC TGCTTTATGG CACGCTGATT
 301 GCGGTTATTG TGATGATTTT GATGCCGAAC TCGGGCAGCT TCGGTTTCGG
 351 CTATGCGTCG CTGGCGGCTT TGTCGTTCGG CGCGCTGATG ATTGCGCTGT
 401 TAGACGTGTC GTCAAATATG GCGATGCAGC CGTTTAAGAT GATGGTCGGC
 451 GACATGGTCA ACGAGGAGCA GAAAGGCTAC GCCTACGGGA TTCAAAGTTT
 501 CTTAGCAAAT ACGGGCGCGG TCGTGGCGGC GATTCTGCCG TTTGTGTTTG
 551 CGTATATCGG TTTGGCGAAC ACCGCCGAGA AGGCGTTGT GCCGCAGACC
 601 GTGGTCGTGG CGTTTTATGT GGGTGCGGCG TTGCTGGTGA TTACCAGCGC
 651 GTTCACGATT TTCAAAGTGA AGGAATACGA TCCGGAAACC TACGCCCGTT
 701 ACCACGGCAT CGATGTCGCC GCGAATCAGG AAAAAGCCAA CTGGATCGAA
 751 CTCTTGAAAA CCGCGCCTAA GGCGTTTTGG ACGGTTACTT TGGTGCAATT
 801 CTTCTGCTGG TTCGCCTTCC AATATATGTG GACTTACTCG GCAGGCGCGA
 851 TTGCGGAAAA CGTCTGGCAC ACCACCGATG CGTCTTCCGT AGGTTATCAG
 901 GAGGCGGGTA ACTGGTACGG CGTTTTGGCG GCGGTGCAGT CGGTTGCGGC
 951 GGTGATTTGT TCGTTTGTAT TGGCGAAAGT GCCGAATAAA TACCATAAGG
1001 CGGGTTATTT CGGCTGTTTG GCTTTGGGCG CGCTCGGCTT TTTCTCCGTT
1051 TTCTTCATCG GCAACCAATA CGCGCTGGTG TTGTCTTATA CCTTAATCGG
1101 CATCGCTTGG GCGGGCATTA TCACTTATCC GCTGACGATT GTGACCAACG
1151 CCTTGTCGGG CAAGCATATG GGCACTTACT TGGGCTTGTT TAACGGCTCT
1201 ATCTGTATGC TCAAATCGT CGCTTCGCTG TTGAGTTTCG TGCTTTTCCC
1251 TATGCTGGGC GGCTTGCAGG CCACTATGTT CTTGGTAGGG GGCGTCGTCC
1301 TGCTGCTGGG CGCGTTTTCC GTGTTCCTGA TTAAAGAAAC ACACGGCGGG
1351 GTTTGA
```

This corresponds to the amino acid sequence <SEQ ID 150; ORF16-1>:

```
  1 MSEYTPQTAK QGLPALAKST IWMLSFGFLG VQTAFTLQSS QMSRIFQTLG
 51 ADPHNLGWFF ILPPLAGMLV QPIVGHYSDR TWKPRLGGRR LPYLLYGTLI
101 AVIVMILMPN SGSFGFGYAS LAALSFGALM IALLDVSSNM AMQPFKMMVG
151 DMVNEEQKGY AYGIQSFLAN TGAVVAAILP FVFAYIGLAN TAEKGVVPQT
201 VVVAFYVGAA LLVITSAFTI FKVKEYDPET YARYHGIDVA ANQEKANWIE
251 LLKTAPKAFW TVTLVQFFCW FAFQYMWTYS AGAIAENVWH TTDASSVGYQ
301 EAGNWYGVLA AVQSVAAVIC SFVLAKVPNK YHKAGYFGCL ALGALGFFSV
351 FFIGNQYALV LSYTLIGIAW AGIITYPLTI VTNALSGKHM GTYLGLFNGS
```

```
401 ICMPQIVASL LSFVLFPMLG GLQATMFLVG GVVLLLGAFS VFLIKETHGG

451 V*
```

Computer analysis of this amino acid sequence gave the following results:

Homology with a Predicted ORF from *N. meningitidis* (Strain A)

ORF16 shows 96.7% identity over a 181aa overlap with an ORF (ORF16a) from strain A of *N. meningitidis*:

```
                                       10        20        30
orf16.pep                       GHYSDRTWKPLRXGRRLPYLLYGTLIAVIV
                                |||||||||||||| |||||||||||||||
orf16a      IFQTLGADPHSLGWFFILPPLAGMLVQPIVGHYSDRTWKPRLGGRRLPYLLYGTLIAVIV
                  50        60        70        80        90       100
                    40        50        60        70        80        90
orf16.pep   MILMPNSGSFGFGYASLAALSFGALMIALLDVSSNMAMQPFKMMVGDMVNEEQKXYAYGI
            |||||||||||||||||||||||||||||||||||||||||||||||||||||| |||||
orf16a      MILMPNSGSFGFGYASLAALSFGALMIALLDVSSNMAMQPFKMMVGDMVNEEQKGYAYGI
                 110       120       130       140       150       160
                   100       110       120       130       140       150
orf16.pep   QSFLANTGAVVAAILPFVFAYIGLANTAXKGVVPQTVVVAFYVGAALLVITSAFTIFKVK
            |||||||||||||||||||||||||||||| |||||||||||||||||||||||||||||
orf16a      QSFLANTGAVVAAILPFVFAYIGLANTAEKGVVPQTVVVAFYVGAALLVITSAFTIFKVK
                 170       180       190       200       210       220
                   160       170       180
orf16.pep   EYXPETYARYHGIDVAANQEKANWIALLKXA
            || |||||||||||||||||||||||| :|
orf16a      EYNPETYARYHGIDVAANQEKANWIELLKTAPKAFWTVTLVQFFCWFAFQYMWTYSAGAI
                 230       240       250       260       270       280
orf16a      AENVWHTTDASSVGYQEAGNWYGVLAAVQSVAAVICSFVLAKVPNKYHKAGYFGCLALGA
                 290       300       310       320       330       340
```

The complete length ORF16a nucleotide sequence <SEQ ID 151> is:

```
  1 ATGTCGGAAT ATACGCCTCA AACAGCAAAA CAAGGTTTGC CCGCGCTGGC

51 AAAAAGCACG ATTTGGATGC TCAGTTTCGG CTTTCTCGGC GTTCAGACGG

101 CCTTTACCCT GCAAAGCTCG CAGATGAGCC GCATCTTCCA GACGCTCGGT

151 GCCGATCCGC ACAGCCTCGG CTGGTTCTTT ATCCTGCCGC CGCTGGCGGG

201 GATGCTGGTG CAGCCGATTG TCGGCCATTA CTCCGACCGC ACTTGGAAGC

251 CGCGTTTGGG CGGCCGCCGT CTGCCGTATC TGCTTTATGG CACGCTGATT

301 GCGGTTATTG TGATGATTTT GATGCCGAAC TCGGGCAGCT TCGGTTTCGG

351 CTATGCGTCG CTGGCGGCTT TGTCGTTCGG CGCGCTGATG ATTGCGCTGT

401 TAGACGTGTC GTCAAATATG GCGATGCAGC CGTTTAAGAT GATGGTCGGC

451 GACATGGTCA ACGAGGAGCA GAAAGGCTAC GCCTACGGGA TTCAAAGTTT

501 CTTAGCGAAT ACGGGCGCGG TCGTGGCGGC GATTCTGCCG TTTGTGTTTG

551 CGTATATCGG TTTGGCGAAC ACCGCCGAGA AAGGCGTTGT GCCGCAGACC

601 GTGGTCGTGG CGTTTTATGT GGGTGCGGCG TTGCTGGTGA TTACCAGCGC

651 GTTCACGATT TTCAAAGTGA AGGAATACAA TCCGGAAACC TACGCCCGTT

701 ACCACGGCAT CGATGTCGCC GCGAATCAGG AAAAAGCCAA CTGGATCGAA
```

```
 751 CTCTTGAAAA CCGCGCCTAA GGCGTTTTGG ACGGTTACTT TGGTGCAATT

801 CTTCTGCTGG TTCGCCTTCC AATATATGTG GACTTACTCG GCAGGCGCGA

851 TTGCGGAAAA CGTCTGGCAC ACCACCGATG CGTCTTCCGT AGGTTATCAG

901 GAGGCGGGTA ACTGGTACGG CGTTTTGGCG GCGGTGCAGT CGGTTGCGGC

951 GGTGATTTGT TCGTTTGTAT TGGCGAAAGT GCCGAATAAA TACCATAAGG

1001 CGGGTTATTT CGGCTGTTTG GCTTTGGGCG CGCTCGGCTT TTTCTCCGTT

1051 TTCTTCATCG GCAACCAATA CGCGCTGGTG TTGTCTTATA CCTTAATCGG

1101 CATCGCTTGG GCGGGCATTA TCACTTATCC GCTGACGATT GTGACCAACG

1151 CCTTGTCGGG CAAGCATATG GGCACTTACT TGGGCCTGTT TAACGGCTCT

1201 ATCTGTATGC CGCAAATCGT CGCTTCGCTG TTGAGTTTCG TGCTTTTCCC

1251 TATGCTGGGC GGCTTGCAGG CCACTATGTT CTTGGTAGGG GGCGTCGTCC

1301 TGCTGCTGGG CGCGTTTTCC GTGTTCCTGA TTAAAGAAAC ACACGGCGGG

1351 GTTTGA
```

This encodes a protein having amino acid sequence <SEQ ID 152>:

```
  1 MSEYTPQTAK QGLPALAKST IWMLSFGFLG VQTAFTLQSS QMSRIFQTLG

51 ADPHSLGWFF ILPPLAGMLV QPIVGHYSDR TWKPRLGGRR LPYLLYGTLI

101 AVIVMILMPN SGSFGFGYAS LAALSFGALM IALLDVSSNM AMQPFKMMVG

151 DMVNEEQKGY AYGIQSFLAN TGAVVAAILP FVFAYIGLAN TAEKGVVPQT

201 VVVAFYVGAA LLVITSAFTI FKVKEYNPET YARYHGIDVA ANQEKANWIE

251 LLKTAPKAFW TVTLVQFFCW FAFQYMWTYS AGAIAENVWH TTDASSVGYQ

301 EAGNWYGVLA AVQSVAAVIC SFVLAKVPNK YHKAGYFGCL ALGALGFFSV

351 FFIGNQYALV LSYTLIGIAW AGIITYPLTI VTNALSGKHM GTYLGLFNGS

401 ICMPQIVASL LSFVLFPMLG GLQATMFLVG GVVLLLGAFS VFLIKETHGG

451 V*
```

ORF16a and ORF16-1 show 99.6% identity in 451 aa overlap:

```
                  10         20         30         40         50         60
orf16a.pep  MSEYTPQTAKQGLPALAKSTIWMLSFGFLGVQTAFTLQSSQMSRIFQTLGADPHSLGWFF
            ||||||||||||||||||||||||||||||||||||||||||||||||||||:||||
orf16-1     MSEYTPQTAKQGLPALAKSTIWMLSFGFLGVQTAFTLQSSQMSRIFQTLGADPHNLGWFF
                  10         20         30         40         50         60

70         80         90        100        110        120
orf16a.pep  ILPPLAGMLVQPIVGHYSDRTWKPRLGGRRLPYLLYGTLIAVIVMILMPNSGSFGFGYAS
            ||||||||||||||||||||||||||||||||||||||||||||||||||||||||||||
orf16-1     ILPPLAGMLVQPIVGHYSDRTWKPRLGGRRLPYLLYGTLIAVIVMILMPNSGSFGFGYAS
                  70         80         90        100        110        120

130        140        150        160        170        180
orf16a.pep  LAALSFGALMIALLDVSSNMAMQPFKMMVGDMVNEEQKGYAYGIQSFLANTGAVVAAILP
            ||||||||||||||||||||||||||||||||||||||||||||||||||||||||||||
orf16-1     LAALSFGALMIALLDVSSNMAMQPFKMMVGDMVNEEQKGYAYGIQSFLANTGAVVAAILP
                 130        140        150        160        170        180
```

-continued

```
              190        200        210        220        230        240
orf16a.pep    FVFAYIGLANTAEKGVVPQTVVVAFYVGAALLVITSAFTIFKVKEYNPETYARYHGIDVA
              ||||||||||||||||||||||||||||||||||||||||||||:|||||||||||||||
orf16-1       FVFAYIGLANTAEKGVVPQTVVVAFYVGAALLVITSAFTIFKVKEYDPETYARYHGIDVA
              190        200        210        220        230        240

250        260        270        280        290        300
orf16a.pep    ANQEKANWIELLKTAPKAFWTVTLVQFFCWFAFQYMWTYSAGAIAENVWHTTDASSVGYQ
              ||||||||||||||||||||||||||||||||||||||||||||||||||||||||||||
orf16-1       ANQEKANWIELLKTAPKAFWTVTLVQFFCWFAFQYMWTYSAGAIAENVWHTTDASSVGYQ
              250        260        270        280        290        300

310        320        330        340        350        360
orf16a.pep    EAGNWYGVLAAVQSVAAVICSFVLAKVPNKYHKAGYFGCLALGALGFFSVFFIGNQYALV
              ||||||||||||||||||||||||||||||||||||||||||||||||||||||||||||
orf16-1       EAGNWYGVLAAVQSVAAVICSFVLAKVPNKYHKAGYFGCLALGALGFFSVFFIGNQYALV
              310        320        330        340        350        360

370        380        390        400        410        420
orf16a.pep    LSYTLIGIAWAGIITYPLTIVTNALSGKHMGTYLGLFNGSICMPQIVASLLSFVLFPMLG
              ||||||||||||||||||||||||||||||||||||||||||||||||||||||||||||
orf16-1       LSYTLIGIAWAGIITYPLTIVTNALSGKHMGTYLGLFNGSICMPQIVASLLSFVLFPMLG
              370        380        390        400        410        420

430        440        450
orf16a.pep    GLQATMFLVGGVVLLLGAFSVFLIKETHGGVX
              |||||||||||||||||||||||||||||||
orf16-1       GLQATMFLVGGVVLLLGAFSVFLIKETHGGVX
              430        440        450
```

Homology with a Predicted ORF from *N. gonorrhoeae*
ORF16 shows 93.9% identity over a 181aa overlap with a predicted ORF (ORF16.ng) from *N. gonorrhoeae*:

```
orf16.pep                                GHYSDRTWKPLRXGRRLPYLLYGTLIAVIV   30
                                         |:|||||||||| |||||||||||||||||
orf16ng    HFSNARRRPAQFGLVFHPAAAGGDAGSADSGYYSDRTWKPRLGGRRLPYLLYGTLIAVIV  131 orf16.pep  MILMPNSGSFGFGYASLAALSFGALMIALLDVSSNMAMQPFKMMVGDMVNEEQKXYAYGI   90
           |||||||||||||||||||||||||||||||||||||||||||||||||||||||| |||
orf16ng    MILMPNSGSFGFGYASLAALSFGALMIALLDVSSNMAMQPFKMMVGDMVNEEQKSYAYGI  191 orf16.pep  QSFLANTGAVVAAILPFVFAYIGLANTAXKGVVPQTVVVAFYVGAALLVITSAFTIFKVK  150
           ||||||| |||||||||||||||||||| ||||||||||||||||||:||||||| ||||
orf16ng    QSFLANTDAVVAAILPFVFAYIGLANTAEKGVVPQTVVVAFYVGAALLIITSAFTISKVK  251 orf16.pep  EYXPETYARYHGIDVAANQEKANWIALLKXA                               181
           ||:||||||||||||||||||||||:|||:|
orf16ng    EYDPETYARYHGIDVAANQEKANWFELLKTAPKVFWTVTPVQFFCWFAFRYMWTYSAGAI  311
```

The complete length ORF16ng nucleotide sequence <SEQ ID 153> is:

```
  1 ATGATAGGGG ATCGCCGCGC CGGCAACCAT TTCGGATTTT CCAAAGCAAA

51 TACTTTTCAA ATCAAAAAAA AGGATTTACT TTATGTCGGA ATATACGCCT

101 CAAACAGCAA AACAAGGTTT GCCCGCGCCG GCAAAAAGCA CGATTTGGAT

151 GTTGAGCTTC GGCTATCTCG GCGTTCAGAC GGCCTTTACC CTGCAAAGCT

201 CGCAGATGAG CCGCATTTTT CAAACGCTAG CGCAGACCCG CACAATTTG

251 GGCTGGTTTT TCATCCTGCC GCCGCTGGCG GGGATGCTGG TTCAGCCGAT

301 AGTGGCTACT ACTCAGACCG CACTTGGAAG CCGCGCTTGG GCGGCCGCCG

351 CCTGCCGTAT CTGCTTTACG GCACGCTGAT TGCGGTCATC GTGATGATTT

401 TGATGCCGAA CTCGGGCAGC TTCGGTTTCG GCTATGCGTC GCTGGCGGCC

451 TTGTCGTTCG GCGCGCTGAT GATTGCGCTG TTGGACGTGT CGTCGAATAT
```

```
501 GGCGATGCAG CCGTTTAAGA TGATGGTCGG CGATATGGTC AACGAGGAGC

551 AGAAAAGCTA CGCCTACGGG ATTCAAAGTT TCTTAGCGAA TACGGACGCG

601 GTTGTGGCAG CGATTCTGCC GTTTGTGTTC GCGTATATCG GTTTGGCGAA

651 CACTGCCGAG AAAGGCGTTG TGCCACAAAC CGTGGTCGTA GCATTCTATG

701 TGGGTGCGGC GTTACTGATT ATTACCAGTG CGTTCACAAT CTCCAAAGTC

751 AAAGAATACG ACCCGGAAAC CTACGCCCGT TACCACGGCA TCGATGTCGC

801 CGCGAATCAG GAAAAAGCCA ACTGGTTCGA ACTCTTAAAA ACCGCGCCTA

851 AAGTGTTTTG GACGGTTACT CCGGTACAGT TTTTCTGCTG GTTCGCCTTC

901 CGGTATATGT GGACTTACTC GGCAGGCGCG ATTGCAGAAA ACGTCTGGCA

951 CACTACCGAT GCGTCTTCCG TAGGCCATCA GGAGGCGGGC AACCGGTACG

1001 GCGTTTTGGC GGCGGTGTAG
```

This encodes a protein having amino acid sequence <SEQ ID 154>:

```
  1 MIGDRRAGNH FGFSKANTFQ IKKKDLLYVG IYASNSKTRF
    ARAGKKHDLD

51 VELRLSRRSD GLYPAKLADE PHFSNARRRP AQFGLVFHPA
    AAGGDAGSAD

101 SGYYSDRTWK PRLGGRRLPY LLYGTLIAVI VMILMPNSGS
    FGFGYASLAA

151 LSFGALMIAL LDVSSNMAMQ PFKMMVGDMV NEEQKSYAYG
    IQSFLANTDA

201 VVAAILPFVF AYIGLANTAE KGVVPQTVVV AFYVGAALLI
    ITSAFTISKV

251 KEYDPETYAR YHGIDVAANQ EKANWFELLK TAPKVFWTVT
    PVQFFCWFAF

301 RYMWTYSAGA IAENVWHTTD ASSVCHQEAG NRYGVLAAV*
```

ORF16ng and ORF16-1 show 89.3% identity in 261 aa overlap:

```
                     30         40         50         60         70         80
orf16-1.pep  MLSFGFLGVQTAFTLQSSQMSRIFQTLGADPHNLGWFFILPPLAGMLVQPI-VGHYSDRT
                          | ::     |    |     ||       :      |:|||||
orf16ng      DVELRLSRRSDGLYPAKLADEPHFSNARRRPAQFGLVF-HPAAAGGDAGSADSGYYSDRT
             50         60         70         80         90        100

90        100        110        120        130        140
orf16-1.pep  WKPRLGGRRLPYLLYGTLIAVIVMILMPNSGSFGFGYASLAALSFGALMIALLDVSSNMA
             ||||||||||||||||||||||||||||||||||||||||||||||||||||||||||||
orf16ng      WKPRLGGRRLPYLLYGTLIAVIVMILMPNSGSFGFGYASLAALSFGALMIALLDVSSNMA
            110        120        130        140        150        160

150        160        170        180        190        200
orf16-1.pep  MQPFKMMVGDMVNEEQKGYAYGIQSFLANTGAVVAAILPFVFAYIGLANTAEKGVVPQTV
             ||||||||||||||||||:|||||||||||| ||||||||||||||||||||||||||||
orf16ng      MQPFKMMVGDMVNEEQKSYAYGIQSFLANTDAVVAAILPFVFAYIGLANTAEKGVVPQTV
            170        180        190        200        210        220

210        220        230        240        250        260
orf16-1.pep  VVAFYVGAALLVITSAFTIFKVKEYDPETYARYHGIDVAANQEKANWIELLKTAPKAFWT
             ||||||||||:||||||| ||||||||||||||||||||||||||||:|||||||:|||
orf16ng      VVAFYVGAALLIITSAFTISKVKEYDPETYARYHGIDVAANQEKANWFELLKTAPKVFWT
            230        240        250        260        270        280

270        280        290        300        310        320
orf16-1.pep  VTLVQFFCWFAFQYMWTYSAGAIAENVWHTTDASSVGYQEAGNWYGVLAAVQSVAAVICS
             || ||||||||| |||||||||||||||||||||| :||||| ||||||||
orf16ng      VTPVQFFCWFAFRYMWTYSAGAIAENVWHTTDASSVGHQEAGNRYGVLAAVX
            290        300        310        320        330        340
```

Based on this analysis, including the presence of several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 19

The following partial DNA sequence was identified in *N. meningitidis* <SEQ ID 155>:

```
  1 ATGTTGTTCC GTAAAACGAC CGCCGCCGTT TTGGCGCATA
    CCTTGATGCT

51 GAACGGCTGT ACGTTGATGT TGTGGGGAAT GAACAACCCG
    GTCAGCGAAA

101 CAATCACCCG NAAACACGTT GNCAAAGACC AAATCCGNGN
    CTTCGGTGTG

151 GTTGCCGAAG ACAATGCCCA ATTGGAAAAG GGCAGCCTGG
    TGATGATGGG

201 CGCAAAATAC TGGTTCGTCG TCAATCCCGA AGATTCGGCG
    AA.NTGACGG

251 GNATTTTGAN GGCAGGGCTG GACAAACCCT TCCAAATAGT
    TNAGGATACC

301 CCGAGCTATG C.TGCCACCA AGCCCTGCCG GTCAAACTCG
    GATCGNCTGG

351 CAGCCAGAAT...
```

This corresponds to the amino acid sequence <SEQ ID 156; ORF28>:

```
  1 MLFRKTTAAV LAHTLMLNGC TLMLWGMNNP VSETITRKHV
    XKDQIRXFGV

51 VAEDNAQLEK GSLVMMGGKY WFVVNPEDSA XXTGILXAGL
    DKPFQIVXDT

101 PSYXCHQALP VKLGSXGSQN ...
```

Further work revealed the complete nucleotide sequence <SEQ ID 157>:

```
  1 ATGTTGTTCC GTAAAACGAC CGCCGCCGTT TTGGCGGCAA
    CCTTGATGCT

51 GAACGGCTGT ACGTTGATGT TGTGGGGAAT GAACAACCCG
    GTCAGCGAAA

101 CAATCACCCC CAAACACGTT GACAAAGACC AAATCCGCGC
    CTTCGGTGTG

151 GTTGCCGAAG ACAATGCCCA ATTGGAAAAG GGCAGCCTGG
    TGATGATGGG

201 CGGAAAATAC TGGTTCGTCG TCAATCCCGA AGATTCGGCG
    AAGCTGACGG

251 GCATTTTGAA GGCAGGGCTG GACAAACCCT TCCAAATAGT
    TGAGGATACC

301 CCGAGCTATG CTCGCCACCA AGCCCTGCCG GTCAAACTCG
    AATCGCCTGG

351 CAGCCAGAAT TTCAGTACCG AAGGCCTTTG CCTGCGCTAC
    GATACCGACA

401 AGCCTGCCGA CATCGCCAAG CTGAAACAGC TCGGGTTTGA
    AGCGGTCAAA

451 CTCGACAATC GGACCATTTA CACGCGCTGC GTATCCGCCA
    AAGGCAAATA

501 CTACGCCACA CCGCAAAAAC TGAACGCCGA TTACCATTTT
    GAGCAAAGTG

551 TGCCTGCCGA TATTTATTAC ACGGTTACTG AAGAACATAC
    CGACAAATCC

601 AAGCTGTTTG CAAATATCTT ATATACGCCC CCCTTTTTGA
    TACTGGATGC

651 GGCGGGCGCG GTACTGGCCT TGCCTGCGGC GGCTCTGGGT
    GCGGTCGTGG

701 ATGCCGCCCG CAAATGA
```

This corresponds to the amino acid sequence <SEQ ID 158; ORF28-1>:

```
  1 MLFRKTTAAV LAATLMLNGC TLMLWGMNNP VSETITRKHV
    DKDQIRAFGV

51 VAEDNAQLEK GSLVMMGGKY WFVVNPEDSA KLTGILKAGL
    DKPFQIVEDT

101 PSYARHQALP VKLESPGSQN FSTEGLCLRY DTDKPADIAK
    LKQLGFEAVK

151 LDNRTTYTRC VSAKGKYYAT PQKLNADYHF EQSVPADIYY
    TVTEEHTDKS

201 KLFANILYTP PFLILDAAGA VLALPAAALG AVVDAARK*
```

Computer analysis of this amino acid sequence gave the following results:

Homology with a Predicted ORF from *N. meningitidis* (Strain A)

ORF28 shows 79.2% identity over a 120aa overlap with an ORF (ORF28a) from strain A of *N. meningitidis*:

```
                      10         20         30         40         50         60
orf28.pep   MLFRKTTAAVLAHTLMLNGCTLMLWGMNNPVSETITRKHVXKDQIRXFGVVAEDNAQLEK
            |||||||||||| ||||||||:|||| :| ||| :|||| |||||  ||||||||||||
orf28a      MLFRKTTAAVLAATLMLNGCTVMMWGMNSPFSETTARKHVDKDQIRAFGVVAEDNAQLEK
                      10         20         30         40         50         60

70         80         90        100        110        120
orf28.pep   GSLVMMGGKYWFVVNPEDSAXXTGILXAGLDKPFQIVXDTPSYXCHQALPVKLGSXGSQN
            ||||||||||||||||||||    ||||  |||| ||:|  :|  :  :||||||  :|||
orf28a      GSLVMMGGKYWFVVNPEDSAKLTGILKAGLDKQFQMVEPNPRFA-YQALPVKLESPASQN
                      70         80         90        100        110
```

```
orf28a    FSTEGLCLRYDTDRPADIAKLKQLEFEAVELDNRTIYTRCVSAKGKYYATPQKLNADYHF
          120       130       140       150       160       170
```

The complete length ORF28a nucleotide sequence <SEQ ID 159> is:

```
  1 ATGTTGTTCC GTAAAACGAC CGCCGCCGTT TTGGCGGCAA
    CCTTGATGTT

51 GAACGCCTGT ACGGTAATGA TGTGGGGTAT GAACAGCCCG
    TTCAGCGAAA

101 CGACCGCCCG CAAACACGTT GACAAGGACC AAATCCGCGC
    CTTCGGTGTG

151 GTTGCCGAAG ACAATGCCCA ATTGGAAAAG GGCAGCCTGG
    TGATGATGGG

201 CGGGAAATAC TGGTTCGTCG TCAATCCTGA AGATTCGGCG
    AAGCTGACGG

251 GCATTTTGAA GGCCGGGTTG GACAAGCAGT TCAAATGGT
    TGAGCCCAAC

301 CCGCGCTTTG CCTACCAAGC CCTGCCGGTC AAACTCGAAT
    CGCCCGCCAG

351 CCAGAATTTC AGTACCGAAG GCCTTTGCCT GCGCTACGAT
    ACCGACAGAC

401 CTGCCGACAT CGCCAAGCTG AAACAGCTTG AGTTTGAAGC
    GGTCGAACTC

451 GACAATCGGA CCATTTACAC GCGCTGCGTC TCCGCCAAAG
    GCAAATACTA

501 CGCCACACCG CAAAAACTGA ACGCCGATTA TCATTTTGAG
    CAAAGTGTGC

551 CTGCCGATAT TTATTACACG GTTACGAAAA AACATACCGA
    CAAATCCAAG

601 TTGTTTGAAA ATATTGCATA TACGCCCACC ACGTTGATAC
    TGGATGCGGT

651 GGGCGCGGTG CTGGCCTTGC CTGTCGCGGC GTTGATTGCA
    GCCACGAATT

701 CCTCAGACAA ATGA
```

This encodes a protein having amino acid sequence <SEQ ID 160>:

```
  1 MLFRKTTAAV LAATLMLNGC TVMMWGMNSP FSETTARKHV
    DKDQIRAFGV

51 VAEDNAQLEK GSLVMMGGKY WFVVNPEDSA KLTGILKAGL
    DKQFQMVEPN

101 PRFAYQALPV KLESPASQNF STEGLCLRYD TDRPADIAKL
    KQLEFEAVEL

151 DNRTIYTRCV SAKGKYYATP QKLNADYHFE QSVPADIYYT
    VTKKHTDKSK

201 LFENIAYTPT TLILDAVGAV LALPVAALIA ATNSSDK*
```

ORF28a and ORF28-1 show 86.1% identity in 238 aa overlap:

```
                10        20        30        40        50        60
orf28a.pep  MLFRKTTAAVLAATLMLNGCTVMMWGMNSPFSETTARKHVDKDQIRAFGVVAEDNAQLEK
            ||||||||||||||||||||| : |||| :  |||  : |||||||||||||||||||||
orf28-1     MLFRKTTAAVLAATLMLNGCTLMLWGMNNPVSETITRKHVDKDQIRAFGVVAEDNAQLEK
                10        20        30        40        50        60

70        80        90       100       110      119
orf28a.pep  GSLVMMGGKYWFVVNPEDSAKLTGILKAGLDKQFQMVEPNPRFA-YQALPVKLESPASQN
            |||||||||||||||||||||||||||||||| ::|| : : :  ||||||||||||:||
orf28-1     GSLVMMGGKYWFVVNPEDSAKLTGILKAGLDKPFQIVEDTPSYARHQALPVKLESPGSQN
                70        80        90       100       110       120

120       130       140       150       160       170      179
orf28a.pep  FSTEGLCLRYDTDRPADIAKLKQLEFEAVELDNRTIYTRCVSAKGKYYATPQKLNADYHF
            |||||||||||||| ||||||||| |||| ||||||||||||||||||||||||||||||
orf28-1     FSTEGLCLRYDTDKPADIAKLKQLGFEAVKLDNRTIYTRCVSAKGKYYATPQKLNADYHF
               130       140       150       160       170       180

180       190       200       210       220       230
orf28a.pep  EQSVPADIYYTVTKKHTDKSKLFENIAYTPTTLILDAVGAVLALPVAALIAATNSSDKX
            |||||||||||| ::|||||||||| : ||| ||||| ||||||| ::| | : :: ||
orf28-1     EQSVPADIYYTVTEEHTDKSKLFANILYTPPFLILDAAGAVLALPAAALGAVVDAARKX
               190       200       210       220       230
```

Homology with a Predicted ORF from *N. gonorrhoeae*

ORF28 shows 84.2% identity over a 120aa overlap with a predicted ORF (ORF28.ng) from *N. gonorrhoeae*:

```
orf28.pep    MLFRKTTAAVLAHTLMLNGCTLMLWGMNNPVSETITRKHVXKDQIRXFGVVAEDNAQLEK   60
             ||||||||||||  ||:|||||:||  |||||||||:||||||  |||||  ||||||||||||
orf28ng      MLFRKTTAAVLAATLILNGCTMMLRGMNNPVSQTITRKHVDKDQIRAFGVVAEDNAQLEK   60 orf28.pep    GSLVMMGGKYWFVVNPEDSAXXTGILXAGLDKPFQIVXDTPSYXCHQALPVKLGSXGSQN   120
             ||||||||||||:|||||||  ||:| ||||||||||| |||||  ||||||||: : ||||
orf28ng      GSLVMMGGKYWFAVNPEDSAKLTGLLKAGLDKPFQIVEDTPSYARHQALPVKFEAPGSQN   120
```

The complete length ORF28ng nucleotide sequence <SEQ ID 161> is

```
  1 ATGTTGTTCC GTAAAACGAC CGCCGCCGTT TTGGCGGCAA
    CCTTGATACT
 51 GAACGGCTGT ACGATGATGT TGCGGGGGAT GAACAACCCG
    GTCAGCCAAA
101 CAATCACCCG CAAACACGTT GACAAAGACC AAATCCGCGC
    CTTCGGTGTG
151 GTTGCCGAAG ACAATGCCCA ATTGGAAAAG GGCAGCCTGG
    TGATGATGGG
201 CGGGAAATAC TGGTTCGCCG TCAATCCCGA AGATTCGGCG
    AAGCTGACGG
251 GCCTTTTGAA GGCCGGGTTG GACAAGCCCT TCCAAATAGT
    TGAGGATACC
301 CCGAGCTATG CCCGCCACCA AGCCCTGCCG GTCAAATTCG
    AAGCGCCCGG
351 CAGCCAGAAT TTCAGTACCG GAGGTCTTTG CCTGCGCTAT
    GATACCGGCA
401 GACCTGACGA CATCGCCAAG CTGAAACAGC TTGAGTTTAA
    AGCGGTCAAA
451 CTCGACAATC GGACCATTTA CACGCGCTGC GTATCCGCCA
    AAGGCAAATA
501 CTACGCCACG CCGCAAAAAC TGAACGCCGA TTATCATTTT
    GAGCAAAGTG
551 TGCCCGCCGA TATTTATTAT ACGGTTACTG AAAAACATAC
    CGACAAATCC
601 AAGCTGTTTG GAAATATCTT ATATACGCCC CCCTTGTTGA
    TATTGGATGC
651 GGCGGCCGCG GTGCTGGTCT TGCCTATGGC TCTGATTGCA
    GCCGCGAATT
701 CCTCAGACAA ATGA
```

This encodes a protein having amino acid sequence <SEQ ID 162>:

```
  1 MLFRKTTAAV LAATLILNGC TMMLRGMNNP VSQTITRKHV
    DKDQIRAFGV
 51 VAEDNAQLEK GSLVMMGGKY WFAVNPEDSA KLTGLLKAGL
    DKPFQIVEDT
101 PSYARHQALP VKFEAPGSQN FSTGGLCLRY DTGRPDDIAK
    LKQLEFKAVK
151 LDNRTIYTRC VSAKGKYYAT PQKLNADYHF EQSVPADIYY
    TVTEKHTDKS
201 KLFGNILYTP PLLILDAAAA VLVLPMALIA AANSSDK*
```

ORF28ng and ORF28-1 share 90.0% identity in 231 aa overlap:

```
                   10         20         30         40         50         60
orf28-1.pep  MLFRKTTAAVLAATLMLNGCTLMLWGMNNPVSETITRKHVDKDQIRAFGVVAEDNAQLEK
             ||||||||||||||:|||||:||  |||||||||:|||||||||||||||||||||||||
orf28ng      MLFRKTTAAVLAATLILNGCTMMLRGMNNPVSQTITRKHVDKDQIRAFGVVAEDNAQLEK
                   10         20         30         40         50         60

70         80         90        100        110        120
orf28-1.pep  GSLVMMGGKYWFVVNPEDSAKLTGILKAGLDKPFQIVEDTPSYARHQALPVKLESPGSQN
             ||||||||||||:||||||||||||:|||||||||||||||||||||||||||:|:||||
orf28ng      GSLVMMGGKYWFAVNPEDSAKLTGLLKAGLDKPFQIVEDTPSYARHQALPVKFEAPGSQN
                   70         80         90        100        110        120

130        140        150        160        170        180
orf28-1.pep  FSTEGLCLRYDTDKPADIAKLKQLGFEAVKLDNRTIYTRCVSAKGKYYATPQKLNADYHF
             ||| ||||||||:| |||||||||| |||||||||||||||||||||||||||||||||
orf28ng      FSTGGLCLRYDTGRPDDIAKLKQLEFKAVKLDNRTIYTRCVSAKGKYYATPQKLNADYHF
                  130        140        150        160        170        180

190        200        210        220        230    239
orf28-1.pep  EQSVPADIYYTVTEEHTDKSKLFANILYTPPFLILDAAGAVLALPAAALGAVVDAARKX
             ||||||||||||||:||||||||:||||||:||||||||  ||||:|||:||  | ::|:
orf28ng      EQSVPADIYYTVTEKHTDKSKLFGNILYTPPLLILDAAAAVLVLPMALIAAANSSDKX
                  190        200        210        220        230
```

Based on this analysis, including the presence of a putative transmembrane domain in the gonococcal protein, it was predicted that the proteins from *N. meningitidis* and *N. gonorrhoeae*, and their epitopes, could be useful antigens for vaccines or diagnostics, or for raising antibodies.

ORF28-1 (24 kDa) was cloned in pET and pGex vectors and expressed in *E. coli*, as described above. The products of protein expression and purification were analyzed by SDS-PAGE. FIG. 6A shows the results of affinity purification of the GST-fusion protein, and FIG. 6B shows the results of expression of the His-fusion in *E. coli*. Purified GST-fusion protein was used to immunise mice, whose sera were used for ELISA, which gave a positive result. These experiments confirm that ORF28-1 is a surface-exposed protein, and that it may be a useful immunogen.

Example 20

The following partial DNA sequence was identified in *N. meningitidis* <SEQ ID 163>:

```
  1 . . . GTCAGTCCTG TACTGCCTAT TACACACGAA
        CGGACAGGGT TTGAAGGTGT
 51 TATCGGTTAT GAAACCCATT TTTCAGGGCA CGGACATGAA
        GTACACAGTC
101 CGTTCGATCA TCATGATTCA AAAAGCACTT CTGATTTCAG
        CGGCGGTGTA
151 GACGGCGGTT TTACTGTTTA CCAACTTCAT CGAACATGGT
        CGGAAATCCA
201 TCCGGAGGAT GAATATGACG GGCCGCAAGC AGCG.ATTAT
        CCGCCCCCCG
251 GAGGAGCAAG GGATATATAC AGCTATTATG TCAAAGGAAC
        TTCAACAAAA
301 ACAAAGACTA GTATTGTCCC TCAAGCCCCA TTTTCAGACC
        GTTGGCTAGA
351 AGAAAATGCC GGTCCCGCCT CTGGT . . .
```

This corresponds to the amino acid sequence <SEQ ID 164; ORF29>:

```
  1 ..VSPVLPITHE RTGFEGVIGY ETHFSGHGHE VHSPFDHHDS KSTSDFSGGV
 51   DGGFTVYQLH RTWSEIHPED EYDGPQAAXY PPPGGARDIY SYYVKGTSTK
101   TKTSIVPQAP FSDRWLEENA GAASG..
```

Further work revealed the complete nucleotide sequence <SEQ ID 165>:

```
  1 ATGAATTTGC CTATTCAAAA ATTCATGATG CTGTTTGCAG CAGCAATATC
 51 GTTGCTGCAA ATCCCCATTA GTCATGCGAA CGGTTTGGAT GCCCGTTTGC
101 GCGATGATAT GCAGGCAAAA CACTACGAAC CGGGTGGTAA ATACCATCTG
151 TTTGGTAATG CTCGCGGCAG TCTTAAAAAG CGGGTTTACG CCGTCCAGAC
201 ATTTGATGCA ACTGCGGTCA GTCCTGTACT GCCTATTACA CACGAACGGA
251 CAGGGTTTGA AGGTGTTATC GGTTATGAAA CCCATTTTTC AGGGCACGGA
301 CATGAAGTAC ACAGTCCGTT CGATCATCAT GATTCAAAAA GCACTTCTGA
351 TTTCAGCGGC GGTGTAGACG GCGGTTTTAC TGTTTACCAA CTTCATCGAA
401 CAGGGTCGGA AATCCATCCG GAGGATGGAT ATGACGGGCC GCAAGGCAGC
451 GATTATCCGC CCCCCGGAGG AGCAAGGGAT ATATACAGCT ATTATGTCAA
501 AGGAACTTCA ACAAAACAA AGACTAATAT TGTCCCTCAA GCCCCATTTT
551 CAGACCGTTG GCTAAAAGAA AATGCCGGTG CCGCCTCTGG TTTTTTCAGC
601 CGTGCGGATG AAGCAGGAAA ACTGATATGG GAAAGCGACC CCAATAAAAA
651 TTGGTGGGCT AACCGTATGG ATGATGTTCG CGGCATCGTC CAAGGTGCGG
701 TTAATCCTTT TTTAATGGGT TTTCAAGGAG TAGGGATTGG GGCAATTACA
751 GACAGTGCAG TAAGCCCGGT CACAGATACA GCCGCGCAGC AGACTCTACA
801 AGGTATTAAT GATTTAGGAA AATTAAGTCC GGAAGCACAA CTTGCTGCCG
851 CGAGCCTATT ACAGGACAGT GCTTTTGCGG TAAAAGACGG TATCAACTCT
901 GCCAAACAAT GGGCTGATGC CCATCCAAAT ATAACAGCTA CTGCCCAAAC
951 TGCCCTTTCC GCAGCAGAGG CCGCAGGTAC GGTTTGGAGA GGTAAAAAAG
```

```
1001 TAGAACTTAA CCCGACTAAA TGGGATTGGG TTAAAAATAC CGGTTATAAA

1051 AAACCTGCTG CCCGCCATAT GCAGACTTTA GATGGGGAGA TGGCAGGTGG

1101 GAATAAACCT ATTAAATCTT TACCAAACAG TGCCGCTGAA AAAAGAAAAC

1151 AAAATTTTGA GAAGTTTAAT AGTAACTGGA GTTCAGCAAG TTTTGATTCA

1201 GTGCACAAAA CACTAACTCC CAATGCACCT GGTATTTTAA GTCCTGATAA

1251 AGTTAAAACT CGATACACTA GTTTAGATGG AAAAATTACA ATTATAAAAG

1301 ATAACGAAAA CAACTATTTT AGAATCCATG ATAATTCACG AAAACAGTAT

1351 CTTGATTCAA ATGGTAATGC TGTGAAAACC GGTAATTTAC AAGGTAAGCA

1401 AGCAAAAGAT TATTTACAAC AACAAACTCA TATCAGGAAC TTAGACAAAT

1451 GA
```

This corresponds to the amino acid sequence <SEQ ID NO: 166; ORF29-1>:

```
  1 MNLPIQKFMM LFAAAISLLQ IPISHANGLD ARLRDDMQAK HYEPGGKYHL

51 FGNARGSVKK RVYAVQTFDA TAVSPVLPIT HERTGFEGVI GYETHFSGHG

101 HEVHSPFDHH DSKSTSDFSG GVDGGFTVYQ LHRTGSEIHP EDGYDGPQGS

151 DYPPPGGARD IYSYYVKGTS TKTKTNIVPQ APFSDRWLKE NAGAASGFFS

201 RADEAGKLIW ESDPNKNWWA NRMDDVRGIV QGAVNPFLMG FQGVGIGAIT

251 DSAVSPVTDT AAQQTLQGIN DLGKLSPEAQ LAAASLLQDS AFAVKDGINS

301 AKQWADAHPN ITATAQTALS AAEAAGTVWR GKKVELNPTK WDWVKNTGYK

351 KPAARHMQTL DGEMAGGNKP IKSLPNSAAE KRKQNFEKFN SNWSSASFDS

401 VHKTLTPNAP GILSPDKVKT RYTSLDGKIT IIKDNENNYF RIHDNSRKQY

451 LDSNGNAVKT GNLQGKQAKD YLQQQTHIRN LDK*
```

Computer analysis of this amino acid sequence gave the following results:

Homology with a Predicted ORF from N. meningitidis (Strain A)

ORF29 shows 88.0% identity over a 125aa overlap with an ORF (ORF29a) from strain A of N. meningitidis:

```
                              10        20        30
orf29.pep                VSPVLPITHERTGFEGVIGYETHFSGHGHE
                         |:|:|||||||||||:||||||||||||||
orf29a     EPGGKYHLFGNARGSVKNRVYAVQTFDATAVGPILPITHERTGFEGIIGYETHFSGHGHE
                  50        60        70        80        90       100
                   40        50        60        70        80        90
orf29.pep   VHSPFDHHDSKSTSDFSGGVDGGFTVYQLHRTWSEIHPEDEYDGPQAAXYPPPGGARDIY
            ||||||:||||||||||||||||||||||||||| |||||| ||||:: |||||||||||
orf29a      VHSPFDNHDSKSTSDFSGGVDGGFTVYQLHRTGSEIHPEDGYDGPQGSDYPPPGGARDIY
               110       120       130       140       150       160
                  100       110       120
orf29.pep   SYYVKGTSTKTKTSIVPQAPFSDRWLEENAGAASG
            ||||||||||:|||:|||||||||||:||||||||
orf29a      XXYVKGTSTKTKSNIVPRAPFSDRWLKENAGAASGFFSRADEAGKLIWESDPNKNWWANR
               170       180       190       200       210       220
orf29a      MDDIRGIVQGAVNPFLMGFQGVGIGAITDSAVSPVTDTAAQQTLQGXNHLGXLSPEAQLA
               230       240       250       260       270       280
```

The complete length ORF29a nucleotide sequence <SEQ ID 167> is:

```
   1 ATGAATTNGC CTATTCAAAA ATTCATGATG CTGTTTGCAG CAGCAATATC
  51 GTNGCTGCAA ATCCCNATTA GTCATGCGAA CGGTTTGGAT GCCCGTTTGC
 101 GCGATGATAT GCAGGCAAAA CACTACGAAC CGGGTGGTAA ATACCATCTG
 151 TTTGGTAATG CTCGCGGCAG TGTTAAAAAT CGGGTTTACG CCGTCCAAAC
 201 ATTTGATGCA ACTGCGGTCG GCCCCATACT GCCTATTACA CACGAACGGA
 251 CAGGATTTGA AGGCATTATC GGTTATGAAA CCCATTTTTC AGGACATGGA
 301 CATGAAGTAC ACAGTCCGTT CGATAATCAT GATTCAAAAA GCACTTCTGA
 351 TTTCAGCGGC GGCGTAGACG GTGGTTTTAC CGTTTACCAA CTTCATCGGA
 401 CAGGGTCGGA AATCCATCCG GAGGATGGAT ATGACGGGCC GCAAGGCAGC
 451 GATTATCCGC CCCCCGGAGG AGCAAGGGAT ATATACANNT ANTATGTCAA
 501 AGGAACTTCA ACAAAAACAA AGAGTAATAT TGTTCCCCGA GCCCCATTTT
 551 CAGACCGCTG GCTAAAAGAA AATGCCGGTG CCGCCTCTGG TTTTTTCAGC
 601 CGTGCTGATG AAGCAGGAAA ACTGATATGG GAAAGCGACC CCAATAAAAA
 651 TTGGTGGGCT AACCGTATGG ATGATATTCG CGGCATCGTC CAAGGTGCGG
 701 TTAATCCTTT TTTAATGGGT TTTCAAGGAG TAGGGATTGG GGCAATTACA
 751 GACAGTGCAG TAAGCCCGGT CACAGATACA GCCGCGCAGC AGACTCTACA
 801 AGGTATNAAT CATTTAGGAA ANTTAAGTCC CGAAGCACAA CTTGCGGCTG
 851 CAACCGCATT ACAAGACAGT GCTTTTGCGG TAAAAGACGG TATCAATTCC
 901 GCCAGACAAT GGGCTGATGC CCATCCGAAT ATAACTGCAA CAGCCCAAAC
 951 TGCCCTTGCC GTAGCAGANG CCGCAACTAC GGTTTGGGGC GGTAAAAAAG
1001 TAGAACTTAA CCCGACCAAA TGGGATTGGG TTAAAAATAC NGGCTATAAN
1051 ACACCTGCTG TTCGCACCAT GCATACTTTG GATGGGGAAA TGGCCGGTGG
1101 GAATAGACCG CCTAAATCTA TAACGTCCAA CAGCAAAGCA GATGCTTCCA
1151 CACAACCGTC TTTACAAGCG CAACTAATTG GAGAACAAAT TANNNNNGGG
1201 CATGCTTATA ACAAGCATGT CATAAGACAA CAAGAATTTA CGGATTTAAA
1251 TATCAATTCA CCAGCAGATT TGCTCGGCA TATTGAAAAT ATTGTTAGCC
1301 ATCCANCAAA TATGAAAGAG TTACCTCGCG GTAGAACTGC GTATTGGGAT
1351 NATAAAACAG GGACNATAGT TATCCGAGAT AAAAATTCTG ACGATGGAGG
1401 TACAGCATTT AGACCAACAT CAGGTAAAAA ATATTATGAT GATTTATAG
```

This encodes a protein having amino acid sequence <SEQ ID 168>:

```
  1 MNXPIQKFMM LFAAAAISXLQ IPISHANGLD ARLRDDMQAK HYEPGGKYHL
 51 FGNARGSVKN RVYAVQTFDA TAVGPILPIT HERTGFEGII GYETHFSGHG
101 HEVHSPFDNH DSKSTSDFSG GVDGGFTVYQ LHRTGSEIHP EDGYDGPQGS
151 DYPPPGGARD IYXXYVKGTS TKTKSNIVPR APFSDRWLKE NAGAASGFFS
201 RADEAGKLIW ESDPNKNWWA NRMDDIRGIV QGAVNPFLMG FQGVGIGAIT
251 DSAVSPVTDT AAQQTLQGXN HLGXLSPEAQ LAAATALQDS AFAVKDGINS
```

```
                            -continued
301 ARQWADAHPN ITATAQTALA VAXAATTVWG GKKVELNPTK WDWVKNTGYX

351 TPAVRTMHTL DGEMAGGNRP PKSITSNSKA DASTQPSLQA QLIGEQIXXG

401 HAYNKHVIRQ QEFTDLNINS PADFARHIEN IVSHPXNMKE LPRGRTAYWD

451 XKTGTIVIRD KNSDDGGTAF RPTSGKKYYD DL*
```

ORF29a and ORF29-1 show 90.1% identity in 385 aa overlap:

```
                        10         20         30         40         50         60
         orf29a.pep    MNXPIQKFMMLFAAAISXLQIPISHANGLDARLRDDMQAKHYEPGGKYHLFGNARGSVKN
                       || |||||||||||| ||||||||||||||||||||||||||||||||||||||||||:
         orf29-1       MNLPIQKFMMLFAAAISLLQIPISHANGLDARLRDDMQAKHYEPGGKYHLFGNARGSVKK
                        10         20         30         40         50         60

70         80         90        100        110        120
         orf29a.pep    RVYAVQTFDATAVGPILPITHERTGFEGIIGYETHFSGHGHEVHSPFDNHDSKSTSDFSG
                       ||||||||||||:|:|||||||||||||:|||||||||||||||||:|||||||||||
         orf29-1       RVYAVQTFDATAVGPVLPITHERTGFEGVIGYETHFSGHGHEVHSPFDHHDSKSTSDFSG
                        70         80         90        100        110        120

130        140        150        160        170        180
         orf29a.pep    GVDGGFTVYQLHRTGSEIHPEDGYDGPQGSDYPPPGGARDIYXXYVKGTSTKTKSNIVPR
                       ||||||||||||||||||||||||||||||||||||||||||   ||||||||:||||:
         orf29-1       GVDGGFTVYQLHRTGSEIHPEDGYDGPQGSDYPPPGGARDIYSYYVKGTSTKTKTNIVPQ
                        130        140        150        160        170        180

190        200        210        220        230        240
         orf29a.pep    APFSDRWLKENAGAASGFFSRADEAGKLIWESDPNKNWWANRMDDIRGIVQGAVNPFLMG
                       ||||||||||||||||||||||||||||||||||||||||||||:|||||||||||||
         orf29-1       APFSDRWLKENAGAASGFFSRADEAGKLIWESDPNKNWWANRMDDVRGIVQGAVNPFLMG
                        190        200        210        220        230        240

250        260        270        280        290        300
         orf29a.pep    FQGVGIGAITDSAVSPVTDTAAQQTLQGXNHLGXLSPEAQLAAATALQDSAFAVKDGINS
                       |||||||||||||||||||||||||||| || |||||||||:|||||||||||||||||
         orf29-1       FQGVGIGAITDSAVSPVTDTAAQQTLQGINDLGKLSPEAQLAAASLLQDSAFAVKDGINS
                        250        260        270        280        290        300

310        320        330        340        350        360
         orf29a.pep    ARQWADAHPNITATAQTALAVAXAATTVWGGKKVELNPTKWDWVKNTGYXTPAVRTMHTL
                       |:||||||||||||||||||::|  || ||| |||||||||||||||||||| ||:|:||
         orf29-1       AKQWADAHPNITATAQTALSAAEEAAGTVWRGKKVELNPTKWDWVKNTGYKKPAARHMQTL
                        310        320        330        340        350        360

370        380        390        400        410        420
         orf29a.pep    DGEMAGGNRPPKSITSNSKADASTQPSLQAQLIGEQIXXGHAYNKHVIRQQEFTDLNINS
                       ||||||||:| ||: || |:  |
         orf29-1       DGEMAGGNKPIKSLP-NSAAEKRKQNFEKFNSNWSSASFDSVHKTLTPNAPGILSPDKVK
                        370        380        390        400        410
```

Homology with a Predicted ORF from *N. gonorrhoeae*

ORF29 shows 88.8% identity over a 125aa overlap with a predicted ORF (ORF29.ng) from *N. gonorrhoeae*:

```
         orf29.pep                                 VSPVLPITHERTGFEGVIGYETHFSGHGHE      30
                                                   |:|:||||||||||||||||||||||||||
         orf29ng      EPGGKYHLFGNARGSVKNRVCAVQTFDATAVGPILPITHERTGFEGVIGYETHFSGHGHE     102 orf29.pep    VHSPFDHHDSKSTSDFSGGVDGGFTVYQLHRTWSEIHPEDEYDGPQAAXYPPPGGARDIY      90
                     |||||:||||||||||||||||||||||||||| |||||| ||||::  ||||||||||
         orf29ng      VHSPFDNHDSKSTSDFSGGVDGGFTVYQLHRTGSEIHPEDGYDGPQGGGYPPPGGARDIY     162 orf29.pep    SYYVKGTSTKTKTSIVPQAPFSDRWLEENAGAASG                               125
                     ||::||||||||| :|| ||||||||:|||||||
         orf29ng      XXHIKGTSTKTKINTVPQAPFSDRWLKENAGAASGFLSRADEAGKLIWENDPDKNWRANR     222
```

The complete length ORF29ng nucleotide sequence <SEQ ID 169> is predicted to encode a protein having amino acid sequence <SEQ ID 170>:

```
  1 MNLPIQKFMM LFAAAISLLQ IPISHANGLD ARLRDDMQAK HYEPGGKYHL
 51 FGNARGSVKN RVCAVQTFDA TAVGPILPIT HERTGFEGVI GYETHFSGHG
101 HEVHSPFDNH DSKSTSDFSG GVDGGFTVYQ LHRTGSEIHP EDGYDGPQGG
151 GYPPPGGARD IYSYHIKGTS TKTKINTVPQ APFSDRWLKE NAGAASGFLS
201 RADEAGKLIW ENDPDKNWRA NRMDDIRGIV QGAVNPFLTG FQGLGVGAIT
251 DSAVSPVTYA AARKTLQGIH NLGNLSPEAQ LAAATALQDS AFAVKDSINS
301 ARQWADAHPN ITATAQTALA VTEAATTVWG GKKVELNPAK WDWVKNTGYK
351 KPAARHMQTV DGEMAGGNKP LESKNTVTTN NFFENTGYTE KVLRQASNGD
401 YHGFPQSVDA FSENGTVIQI VGGDNIVRHK LYIPGSYKGK DGNFEYIREA
451 DGKINHRLFV PNQQLPEK*
```

In a second experiment, the following DNA sequence <SEQ ID 171> was identified:

```
   1 atgAATTTGC CTATTCAAAA ATTCATGATG ctgttggcAg cggcaatatc
  51 gatgctGCat ATCCCCATTA GTCATGCGAA CGGTTTGGAT GCCCGTTTGC
 101 GCGATGATAT GCAGGCAAAA CACTACGAAC CGGGTGGCAA ATACCATCTG
 151 TTTGGTAATG CTCGCGGCAG TGTTAAAAAT CGGGTTTGCG CCGTCCAAAC
 201 ATTTGATGCA ACTGCGGTCG GCCCCATACT GCCTATTACA CACGAACGGA
 251 CAGGATTTGA AGGTGTTATC GGCTATGAAA CCCATTTTTC AGGACACGGA
 301 CACGAAGTAC ACAGTCCGTT CGATAATCAT GATTCAAAAA GCACTTCTGA
 351 TTTCAGCGGC GGCGTAGACG GCGGTTTTAC CGTTTACCAA CTTCATCGGA
 401 CAGGGTCGGA AATACATCCC GCAGACGGAT ATGACGGGCC TCAAGGCGGC
 451 GGTTATCCGG AACCACAAGG GGCAAGGGAT ATATACAGCT ACCATATCAA
 501 AGGAACTTCA ACCAAAACAA AGATAAACAC TGTTCCGCAA GCCCCTTTTT
 551 CAGACCGCTG GCTAAAAGAA AATGCCGGTG CCGCTTCCGG TTTTCTCAGC
 601 CGTGCGGATG AAGCAGGAAA ACTGATATGG GAAAACGACC CCGATAAAAA
 651 TTGGCGGGCT AACCGTATGG ATGATATTCG CGGCATCGTC CAAGGTGCGG
 701 TTAATCCTTT TTTAACGGGT TTTCAAGGGG TAGGGATTGG GGCAATTACA
 751 GACAGTGCGG TAAGCCCGGT CACAGATACA GCCGCTCAGC AGACTCTACA
 801 AGGTATTAAT GATTTAGGAA ATTTAAGTCC GGAAGCACAA CTTGCCGCCG
 851 CGAGCCTATT ACAGGACAGT GCCTTTGCGG TAAAAGACGG CATCAATTCC
 901 GCCAGACAAT GGGCTGATGC CCATCCGAAT ATAACAGCAA CAGCCCAAAC
 951 TGCCCTTGCC GTAGCAGAGG CCGCAGGTAC GGTTTGGCGC GGTAAAAAAG
1001 TAGAACTTAA CCCGACCAAA TGGGATTGGG TTAAAAATAC CGGCTATAAA
1051 AAACCTGCTG CCCGCCATAT GCAGACTGTA GATGGGGAGA TGGCAGGGGG
1101 GAATAGACCG CCTAAATCTA TAACGTCGGA AGGAAAAGCT AATGCTGCAA
1151 CCTATCCTAA GTTGGTTAAT CAGCTAAATG AGCAAAACTT AAATAACATT
1201 GCGGCTCAAG ATCCAAGATT GAGTCTAGCT ATTCATGAGG GTAAAAAAAA
1251 TTTTCCAATA GGAACTGCAA CTTATGAAGA GGCAGATAGA CTAGGTAAAA
1301 TTTGGGTTGG TGAGGGTGCA AGACAAACTA GTGGAGGCGG ATGGTTAAGT
```

```
1351 AGAGATGGCA CTCGACAATA TCGGCCACCA ACAGAAAAAA AATCACAATT

1401 TGCAACTACA GGTATTCAAG CAAATTTTGA AACTTATACT ATTGATTCAA

1451 ATGAAAAAAG AAATAAAATT AAAAATGGAC ATTTAAATAT TAGGTAA
```

This encodes a protein having amino acid sequence <SEQ ID 172; ORF29ng-1>:

```
  1 MNLPIQKFMM LLAAAISMLH IPISHANGLD ARLRDDMQAK HYEPGGKYHL

51 FGNARGSVKN RVCAVQTFDA TAVGPILPIT HERTGFEGVI GYETHFSGHG

101 HEVHSPFDNH DSKSTSDFSG GVDGGFTVYQ LHRTGSEIHP ADGYDGPQGG

151 GYPEPQGARD IYSYHIKGTS TKTKINTVPQ APFSDRWLKE NAGAASGFLS

201 RADEAGKLIW ENDPDKNWRA NRMDDIRGIV QGAVNPFLTG FQGVGIGAIT

251 DSAVSPVTDT AAQQTLQGIN DLGNLSPEAQ LAAASLLQDS AFAVKDGINS

301 ARQWADAHPN ITATAQTALA VAEAAGTVWR GKKVELNPTK WDWVKNTGYK

351 KPAARHMQTV DGEMAGGNRP PKSITSEGKA NAATYPKLVN QLNEQNLNNI

401 AAQDPRLSLA IHEGKKNFPI GTATYEEADR LGKIWVGEGA RQTSGGGWLS

451 RDGTRQYRPP TEKKSQFATT GIQANFETYT IDSNEKRNKI KNGHLNIR*
```

ORF29ng-1 and ORF29-1 show 86.0% identity in 401 aa overlap:

```
                    10         20         30         40         50         60
orf29ng-1.pep  MNLPIQKFMMLLAAAISMLHIPISHANGLDARLRDDMQAKHYEPGGKYHLFGNARGSVKN
               ||||||||||:|||||:|:|||||||||||||||||||||||||||||||||||||||:
orf29-1        MNLPIQKFMMLFAAAISLLQIPISHANGLDARLRDDMQAKHYEPGGKYHLFGNARGSVKK
                    10         20         30         40         50         60

70         80         90        100        110        120
orf29ng-1.pep  RVCAVQTFDATAVGPILPITHERTGFEGVIGYETHFSGHGHEVHSPFDNHDSKSTSDFSG
               || ||||||||||:|:|||||||||||||||||||||||||||||||:||||||||||||
orf29-1        RVYAVQTFDATAVSPVLPITHERTGFEGVIGYETHFSGHGHEVHSPFDHHDSKSTSDFSG
                    70         80         90        100        110        120

130        140        150        160        170        180
orf29ng-1.pep  GVDGGFTVYQLHRTGSEIHPADGYDGPQGGGYPEPQGARDIYSYHIKGTSTKTKINTVPQ
               ||||||||||||||||||||| |||||||: || ||||||||||||::|||||||| |||
orf29-1        GVDGGFTVYQLHRTGSEIHPEDGYDGPQGSDYPPPGGARDIYSYYVKGTSTKTKTNIVPQ
                    130        140        150        160        170        180

190        200        210        220        230        240
orf29ng-1.pep  APFSDRWLKENAGAASGFLSRADEAGKLIWENDPDKNWRANRMDDIRGIVQGAVNPFLTG
               |||||||||||||||||:|||||||||||||:|||:|||||||||:|||||||||||| |
orf29-1        APFSDRWLKENAGAASGFFSRADEAGKLIWESDPNKNWWANRMDDVRGIVQGAVNPFLMG
                    190        200        210        220        230        240

250        260        270        280        290        300
orf29ng-1.pep  FQGVGIGAITDSAVSPVTDTAAQQTLQGINDLGNLSPEAQLAAASLLQDSAFAVKDGINS
               |||||||||||||||||||||||||||||||||:||||||||||||||||||||||||||
orf29-1        FQGVGIGAITDSAVSPVTDTAAQQTLQGINDLGKLSPEAQLAAASLLQDSAFAVKDGINS
                    250        260        270        280        290        300

310        320        330        340        350        360
orf29ng-1.pep  ARQWADAHPNITATAQTALAVAEAAGTVWRGKKVELNPTKWDWVKNTGYKKPAARHMQTV
               |:|||||||||||||||||::|||||||||||||||||||||||||||||||||||||:
orf29-1        AKQWADAHPNITATAQTALSAAEAAGTVWRGKKVELNPTKWDWVKNTGYKKPAARHMQTL
                    310        320        330        340        350        360

370        380        390        400        410        420
orf29ng-1.pep  DGEMAGGNRPPKSI-TSEGKANAATYPKLVNQLNEQNLNNIAAQDPRLSLAIHEGKKNFP
               ||||||||:|  ||: |: ::    ::  |  :  :::::
orf29-1        DGEMAGGNKPIKSLPNSAAEKRKQNFEKFNSWSSASFDSVHKTLTPNAPGILSPDKVKT
                    370        380        390        400        410        420
```

```
             420        430        440        450        460        470      479
orf29ng-1.pep     IGTATYEEADRLGKIWVGEGARQTSGGGWLSRDGTRQYRPPTEKKSQFATTGIQANFETY orf29-1           RYTSLDGKITIIKDNENNYFRIHDNSRKQYLDSNGNAVKTGNLQGKQAKDYLQQQTHIRN
                         430        440        450        460        470        480
```

Based on this analysis, including the presence of a putative leader sequence in the gonococcal protein, it is predicted that the proteins from *N. meningitidis* and *N. gonorrhoeae*, and their epitopes, could be useful antigens for vaccines or diagnostics, or for raising antibodies.

Example 21

The following partial DNA sequence was identified in *N. meningitidis* <SEQ ID 173>:

```
  1 ATGAAAAAAC AAATCACCGC AGCCGTAATG ATGCTGTCTA TGATTGCCCC
 51 CGCAATGGCA AACGGCTTGG ACAATCAGGC ATTTGAAGAC CAAATGTTCC
101 ACACGCGGGC AGATGCACCG ATGCAG...
```

This corresponds to the amino acid sequence <SEQ ID 174; ORF30>:

```
  1 MKKQITAAVM MLSMIAPAMA NGLDNQAFED QMFHTRADAP MQ..
```

Further work revealed the complete nucleotide sequence <SEQ ID 175>:

```
  1 ATGAAAAAAC AAATCACCGC AGCCGTAATG ATGCTGTCTA TGATTGCCCC
 51 CGCAATGGCA AACGGCTTGG ACAATCAGGC ATTTGAAGAC CAAGTGTTCC
101 ACACGCGGGC AGATGCACCG ATGCAGTTGG CGGAGCTTTC TCAAAAGGAG
151 ATGAAGGAGA CAGAGGGGGC GTTTCTTCCA TTGGCTATCT TGGGTGGTGC
201 TGCCATTGGT ATGTGGACAC AGCATGGTTT TAGTTATGCA ACGACAGGCA
251 GACCAGCTTC TGTTAGAGAT GTTGCTATTG CTGGCGGATT AGGCGCAATT
301 CCTGGTGGTG TAGGCGCCGC AGGAAAGGTT GTTTCCTTTG CTAAATATGG
351 ACGTGAGATT AAAATCGGCA ATAATATGCG GATAGCCCCT TTCGGTAATA
401 GAACAGGTCA TCCTATTGGA AAATTTCCCC ATTATCATCG TCGAGTTACG
451 GATAATACGG GCAAGACTTT GCCTGGACAG GGAATTGGTC GTCATCGCCC
501 TTGGGAATCA AAATCTACGG ACAGATCATG GAAAAACCGC TTCTAA
```

This corresponds to the amino acid sequence <SEQ ID 176; ORF30-1>:

```
  1 MKKQITAAVM MLSMIAPAMA NGLDNQAFED QVEHTRADAP
    MQLAELSQKE
```

-continued

```
 51 MKETEGAFLP LAILGGAAIG MWTQHGFSYA TTGRPASVRD
    VAIAGGLGAI
101 PGGVGAAGKV VSFAKYGREI KIGNNMRIAP FGNRTGHPIG
    KFPHYHRRVT
151 DNTGKTLPCQ GIGRHRPWES KSTDRSWKNR F*
```

Computer analysis of this amino acid sequence gave the following results:

Homology with a Predicted ORF from *N. meningitidis* (Strain A)

ORF30 shows 97.6% identity over a 42aa overlap with an ORF (ORF30a) from strain A of *N. meningitidis*:

```
              10        20        30        40
orf30.pep  MKKQITAAVMMLSMIAPAMANGLDNQAFEDQMFHTRADAPMQ
           |||||||||||||||||||||||||||||||:|||||||||
orf30a     MKKQITAAVMMLSMIAPAMANGLDNQAFEDQVFHTRADAPMQLAELSQKEMKXTXGAFLP
              10        20        30        40        50        60
orf30a     LXILGGAAIGMWTQHGFSYATTGRPASVRDVAIAGGLGAIPGXVGAAGKVVSFAKYGREI
              70        80        90       100       110       120
```

The complete length ORF30a nucleotide sequence <SEQ ID 177> is:

```
  1 ATGAAAAAAC AAATCACCGC ACCCGTAATG ATGCTGTCTA
    TGATTGCCCC
 51 CGCAATGGCA AACGGCTTGG ACAATCAGGC ATTTGAAGAC
    CAAGTGTTCC
101 ACACGCGGGA AGATGCACCG ATGCAGTTGG CGGAGCTTTC
    TCAAAAGGAG
151 ATGAAGGANA CAGNGGGGGC GTTTCTTCCA TTGGNTATCT
    TGGGTGGTGC
201 TGCCATTGGT ATGTGGACAC AGCATGGTTT TAGTTATGCA
    ACGACAGGCA
251 GACCAGCTTC TGTTAGAGAT GTTGCTATTG CTGGCGGATT
    AGGCGCAATT
301 CCTGGTGNTG TAGGCGCCGC AGGAAAGGTT GTTTCCTTTG
    CTAAATATGG
351 ACGTGAGATT AAAATCGGCA ATAATATGCG GATAGCCCCT
    TTCGGTAATA
401 GAACAGGTCA TCCTATTGGN AAATTTCCCC ATTATCATCG
    TCGAGTTACG
451 GATAATACGG GCAAGACTTT GCCTGGACAG GGAATTGGTC
    GTCATCGCCC
501 TTGGGAATCA AATCTACGG ACAGATCATG GAAAAACCGC
    TTCTAA
```

This encodes a protein having amino acid sequence <SEQ ID 178>:

```
  1 MKKQITAAVM MLSMIAPAMA NGLDNQAFED QVFHTRADAP
    MQLAELSQKE
 51 MKXTXGAFLP LXILGGAAIG MWTQHGFSYA TTGRPASVRD
    VAIAGGLGAI
101 PGXVGAAGKV VSFAKYGREI KIGNNMRIAP FGNRTGHPIG
    KFPHYHRRVT
151 DNTGKTLPGQ GIGRHRPWES KSTDRSWKNR F*
```

ORF30a and ORF30-1 show 97.8% identity in 181 aa overlap:

```
orf30a.pep  MKKQITAAVMMLSMIAPAMANGLDNQAFEDQVFHTRADAPMQLAELSQKEMKXTXGAFLP   60
            |||||||||||||||||||||||||||||||||||||||||||||||||||| | |||||
orf30-1     MKKQITAAVMMLSMIAPAMANGLDNQAFEDQVFHTRADAPMQLAELSQKEMKETEGAFLP   60
orf30a.pep  LXILGGAAIGMWTQHGFSYATTGRPASVRDVAIAGGLGAIPGXVGAAGKVVSFAKYGREI   120
            | |||||||||||||||||||||||||||||||||||||||| |||||||||||||||||
orf30-1     LAILGGAAIGMWTQHGFSYATTGRPASVRDVAIAGGLGAIPGGVGAAGKVVSFAKYGREI   120
orf30a.pep  KIGNNMRIAPFGNRTGHPIGKFPHYHRRVTDNTGKTLPGQGIGRHRPWESKSTDRSWKNR   180
            ||||||||||||||||||||||||||||||||||||||||||||||||||||||||||||
orf30-1     KIGNNMRIAPFGNRTGHPIGKFPHYHRRVTDNTGKTLPGQGIGRHRPWESKSTDRSWKNR   180
orf30a.pep  FX
            ||
orf30-1     FX
```

Homology with a Predicted ORF from *N. gonorrhoeae*

ORF30 shows 97.6% identity over a 42aa overlap with a predicted ORF (ORF30.ng) from *N. gonorrhoeae*:

```
orf30.pep  MKKQITAAVMMLSMIAPAMANGLDNQAFEDQMFHTRADAPMQ                     42
           |||||||||||||||||||||||||||||||:|||||||||
orf30ng    MKKQITAAVMMLSMIAPAMANGLDNQAFEDQVFHTRADAPMQLAELSQKEMKETEGAFLP   60
```

The complete length ORF30ng nucleotide sequence <SEQ ID 179> is

```
  1 ATGAAAAAAC AAATCACCGC AGCCGTAATG ATGCTGTCTA
    TGATCGCCCC

51 CGCAATGGCA AACGGATTGG ACAATCAGGC ATTTGAAGAC
    CAAGTGTTCC

101 ACACGCGGGC AGATGCGCCG ATGCAGTTGG CGGAGCTTTC
    TCAGAAGGAG

151 ATGAAGGAGA CTGAAGGGGC TTTTCTTCCA TTGGCTATCT
    TGGGTGGTGC

201 TGCCATTGGT ATGTGGACAC AGCATGGTTT TAGTTATGCA
    ACGACAGGCA

251 GACCAGCTTC TGTTAGAGAT GTTGCTGGCG GATTAGGCGC
    AATTCCTGGT

301 GATGTAGGTG CTGCAGGAAA GGTTGTTTCC TTTGCTAAAT
    ATGGACGTGA

351 GATTAAAATC GGCAATAATA TGCGGATAGC CCCTTTCGGT
    AATAGAACAG

401 GTCATCCTAT TGGAAAATTT CCCCATTATC ATCGTCGAGT
    TACGGATAAT

451 ACGGGCAAGA CTTTGCCTGG ACAGGGAATT GGTCGTCATC
    GCCCTTGGGA

501 ATCAAAATCT ACGGACAGAT CATGGAAAAA CCGCTTCTAA
```

This encodes a protein having amino acid sequence <SEQ ID 180>:

```
  1 MKKQITAAVM MLSMIAPAMA NGLDNQAFED QVFHTRADAP
    MQLAELSQKE

51 MKETEGAFLP LAILGGAAIG MWTQHGFSYA TTGRPASVRD
    VAGGLGAIPG

101 DVGAAGKVVS FAKYGREIKI GNNMRIAPFG NRTGHPIGKF
    PHYHRRVTDN

151 TGKTLPGQGI GRHRPWESKS TDRSWKNRF*
```

ORF30ng and ORF30-1 show 98.3% identity in 181 aa overlap:

Based on this analysis, including the presence of a putative leader sequence in the gonococcal protein, it is predicted that the proteins from *N. meningitidis* and *N. gonorrhoeae*, and their epitopes, could be useful antigens for vaccines or diagnostics, or for raising antibodies.

Example 22

The following partial DNA sequence was identified in *N. meningitidis* <SEQ ID 181>:

```
  1 ATGAATAAAA CTCTCTATCG TGTAATTTTC AACCGCAAAC
    GTGGGGCTGT

51 GrTAGCCGTT GCTGAAACTA CCAAGCGCGA AGGTAAAAGC
    TGTGCCGATA

101 GTGATTCAGG CAGCGCTCAT GTGAAATCTG TTCCTTTTGG
    TACTACTCAT

151 GCACCTGTTT GTg.CGTTaC AAATATCTTT TCTTTTTCTT
    TATTGGGCTT

201 TTCTTTATGT TTGGCTGTAG GtacGGyCAA TATTGCTTTT
    GCTGATGGCA

251 TT . . .
```

This corresponds to the amino acid sequence <SEQ ID 182; ORF31>:

```
  1 MNKTLYRVIF NRKRGAVXAV AETTKREGKS CADSDSGSAH
    VKSVPFGTTH

51 APVCXVTNIF SFSLLGFSLC LAVGTXNIAF ADGI . . .
```

Further work revealed a further partial nucleotide sequence <SEQ ID 183>:

```
  1 ATCAATAAAA CTCTCTATCG TGTAATTTTC AACCGCAAAC
    GTGGGGCTGT

51 GGTAGCCGTT GCTGAAACTA CCAAGCGCGA AGGTAAAAGC
    TGTGCCGATA

101 GTGATTCAGG CAGCGCTCAT GTGAAATCTG TTCCTTTTGG
    TACTACTCAT
```

```
                   10        20        30        40        50        60
orf30ng.pep   MKKQITAAVMMLSMIAPAMANGLDNQAFEDQVFHTRADAPMQLAELSQKEMKETEGAFLP
              ||||||||||||||||||||||||||||||||||||||||||||||||||||||||||||
orf30-1       MKKQITAAVMMLSMIAPAMANGLDNQAFEDQVFHTRADAPMQLAELSQKEMKETEGAFLP
                   10        20        30        40        50        60

70        80        90       100       110
orf30ng.pep   LAILGGAAIGMWTQHGFSYATTGRPASVRDVA--GGLGAIPGDVGAAGKVVSFAKYGREI
              |||||||||||||||||||||||||||||||    |||||||| ||||||||||||||||
orf30-1       LAILGGAAIGMWTQHGFSYATTGRPASVRDVAIAGGLGAIPGGVGAAGKVVSFAKYGREI
                   70        80        90       100       110       120

120       130       140       150       160       170
orf30ng.pep   KIGNNMRIAPFGNRTGHPIGKFPHYHRRVTDNTGKTLPGQGIGRHRPWESKSTDRSWKNR
              ||||||||||||||||||||||||||||||||||||||||||||||||||||||||||||
orf30-1       KIGNNMRIAPFGNRTGHPIGKFPHYHRRVTDNTGKTLPGQGIGRHRPWESKSTDRSWKNR
                  130       140       150       160       170       180

180
orf30ng.pep    FX
               ||
orf30-1        FX
```

-continued

```
151 GCACCTGTTT GTCGTTCAAA TATCTTTTCT TTTTCTTTAT
    TGGGCTTTTC

201 TTTATGTTTG GCTGTAGGTA CGGCCAATAT TGCTTTTGCT
    GATGGCATT . . .
```

This corresponds to the amino acid sequence <SEQ ID 184; ORF31-1>:

```
  1 MNKTLYRVIF NRKRGAVVAV AETTKREGKS CADSDSGSAH
    VKSVPFGTTH

51 APVCRSNIFS FSLLGFSLCL AVGTANIAFA DGI . . .
```

Computer analysis of this amino acid sequence gave the following results:

Homology with a Predicted ORF from *N. gonorrhoeae*
ORF31 shows 76.2% identity over a 84aa overlap with a predicted ORF (ORF31.ng) from *N. gonorrhoeae*:

```
orf31.pep    MNKTLYRVIFNRKRGAVXAVAETTKREGKSCADSDSGSAHVKSVPFGTTHAPVCXVTNIF    60
             |||||||||||||||| |||||||||||||||||| ::|||| |  ||     :: |
orf31ng      MNKTLYRVIFNRKRGAVVAVAETTKREGKSCADSGSGSVYVKSVSFIPTH------SKAF   54 orf31.pep    SFSLLGFSLCLAVGTXNIAFADGI                                       84
             || |||||||||:|| |||||||||
orf31ng      CFSALGFSLCLALGTVNIAFADGIITDKAAPKTQQATILQTGNGIPQVNIQTPTSAGVSV   114
```

The complete length ORF31ng nucleotide sequence <SEQ ID 185> is:

```
  1 ATGAACAAAA CCCTCTATCG TGTGATTTTC AACCGCAAAC
    GCGGTGCTGT

51 GGTAGCTGTT GCCGAAACCA CCAAGCGCGA AGGTAAAAGC
    TGTGCCGATA

101 GTGGTTCGGG CAGCGTTTAT GTGAAATCCG TTTCTTTCAT
    TCCTACTCAT

151 TCCAAAGCCT TTTGTTTTTC TGCATTAGGC TTTTCTTTAT
    GTTTGGCTTT

201 GGGTACGGTC AATATTGCTT TTGCTGACGG CATTATTACT
    GATAAAGCTG

251 CTCCTAAAAC CCAACAAGCC ACGATTCTGC AAACAGGTaa
    cGGCATACCG

301 CAAGTCAATA TTCAAACCCC TACTTCGGCA GGGGTTTCTG
    TTAATCAATA

351 TGCCCAGTTT GATGTGGGTA ATCGCGGGGC GATTTTAAAC
    AACAGTCGCA

401 GCAACACCCA AACACAGCTA GGCGGTTGGA TTCAAGGCAA
    TCCTTGGTTG

451 ACAAGGGGCG AAGCACGTGT GGTTGTAAAC CAAATCAACA
    GCAGCCATCC

501 TTCACAACTG AATGGCTATA TTGAAGTGGG TGGACGACGT
    GCAGAAGTCG

551 TTATTGCCAA TCCGGCAGGG ATTGCAGTCA ATGGTGGTGG
    TTTTATCAAT

601 GCTTCCCGTG CCACTTTGAC GACAGGCCAA CCGCAATATC
    AAGCAGGAGA

651 CTTTAGCGGC TTTAAGATAA GGCAAGGCAA TGCTGTAATC
    GCCGGACACG

701 GTTTGGATGC CCGTGATACC GATTTCACAC GTATTCTTGT
    ATGCCAACAA

751 AATCACCTTG ATCAGTACGG CCGAACAAGC AGGCATTCGT
    AA
```

This encodes a protein having amino acid sequence <SEQ ID 186>:

```
  1 MNKTLYRVIF NRKRGAVVAV AETTKREGKS CADSGSGSVY
    VKSVSFIPTH

51 SKAFCFSALG FSLCLALGTV NIAFADGIIT DKAAPKTQQA
    TILQTGNGIP

101 QVNIQTPTSA GVSVNQYAQF DVGNRGAILN NSRSNTQTQL
    GGWIQGNPWL

151 TRGEARVVVN QINSSHPSQL NGYIEVGGRR AEVVIANPAG
    IAVNGGGFIN

201 ASRATLTTGQ PQYQAGDFSG FKIRQGNAVI AGHGLDARDT
    DFTRILVCQQ

251 NHLDQYGRTS RHS*
```

This gonococcal protein shares 50% identity over a 149aa overlap with the pore-forming hemolysins-like HecA protein from *Erwinia chrysanthemi* (accession number L39897):

```
orf31ng    96 GNGIPQVNIQTPTSAGVSVNQYAQFDVGNRGAILNNSRSN-TQTQLGGWIQGNPWLTRGE  154
              GNG+P VNI TP ++G+S N+Y  F+V NRG ILNN  +   T +QLGG IQ NP L
HecA       45 GNGVPVVNIATPDASGLSHNRYHDFNVDNRGLILNNGTARLTPSQLGGLIQNNPNLNGRA  104

Orf31ng   155 ARVVVNQINSSHPSQLNGYIEVGGRRAEVVIANPAGIAVNGGGFINASRATLTTGQPQYQ  214
               A  ++N++ S +  S+L GY+EV G+ A VV+ANP GI  +G GF+N  R TLTTG PQ+
HecA      105 AAAILNEVVSPNRSRLAGYLEVAGQAANVVVANPYGITCSGCGFLNTPRLTLTTGTPQFD  164

Orf31ng   215 -AGDFSGFKIRQGNAVIAGHGLDARDTDF                                242
                AG  SG  +R G+ +I G GLDA  +D+
HecA      165 AAGGLSGLDVRGGDILIDGAGLDASRSDY                                193
```

Furthermore, ORF31ng and ORF31-1 show 79.5% identity in 83 aa overlap:

```
                      10        20        30        40        50        60
   orf31-1.pep   MNKTLYRVIFNRKRGAVVAVAETTKREGKSCADSDSGSAHVKSVPFGTTHAPVCRSNIFS
                 ||||||||||||||||||||||||||||||||||| |||::|||| |  ||      |:|
   orf31ng       MNKTLYRVIFNRKRGAVVAVAETTKREGKSCADSGSGSVYVKSVSFIPTH-----SKAFC
                      10        20        30        40        50
                      70        80
   orf31-1.pep   FSLLGFSLCLAVGTANIAFADGI
                 || ||||||||:||:||||||||
   orf31ng       FSALGFSLCLALGTVNIAFADGIITDKAAPKTQQATILQTGNGIPQVNIQTPTSAGVSVN
                      60        70        80        90       100       110
```

On this basis, including the homology with hemolysins, and also with adhesins, it is predicted that the proteins from *N. meningitidis* and *N. gonorrhoeae*, and their epitopes, could be useful antigens for vaccines or diagnostics, or for raising antibodies.

Example 23

The following partial DNA sequence was identified in *N. meningitidis* <SEQ ID 187>:

```
  1 ATGAATACTC CTCCTTTTGT CTGTTGGATT TTTTGCAAGG
    TCATCGACAA

51 TTTCGGCGAC ATCGGCGTTT CGTGGCGGCT CGCCCGTGTT
    TTGCACCGCG

101 AACTCGGTTG GCAGGTGCAT TTGTGGACGG ACGATGTGTC
    CGCCTTGCGT

151 GCGCTTTGCC CTGATTTGCC CGATGTTCCC TGCGTTCATC
    AGGATATTCA

201 TGTCCGCACT TGGCATTCCG ATGCGGCAGA TATTGATACC
    GCG . . .
```

This corresponds to the amino acid sequence <SEQ ID 188; ORF32>:

```
  1 MNTPPFVCWI FCKVIDNFGD IGVSWRLARV LHRELGWQVH
    LWTDDVSALR

51 ALCPDLPDVP CVHQDIHVRT WHSDAADIDT A . . .
```

Further work revealed the complete nucleotide sequence <SEQ ID 189>:

```
  1 ATGAATACTC CTCCTTTTGT CTGTTGGATT TTTTGCAAGG
    TCATCGACAA
```

-continued
```
 51 TTTCGGCGAC ATCGGCGTTT CGTGGCGGCT CGCCCGTGTT
    TTGCACCGCG

101 AACTCGGTTG GCAGGTGCAT TTGTGGACGG ACGATGTGTC
    CGCCTTGCGT

151 GCGCTTTGCC CTGATTTGCC CGATGTTCCC TGCGTTCATC
    AGGATATTCA

201 TGTCCGCACT TGGCATTCCG ATGCGGCAGA TATTGATACC
    GCGCCTGTTC

251 CCGATGTCGT CATCGAAACT TTTGCCTGCG ACCTGCCCGA
    AAATGTGCTG

301 CACATTATCC GCCGACACAA GCCGCTTTGG CTGAATTGGG
    AATATTTGAG

351 CGCGGAGGAA AGCAATGAAA GGCTGCATCT GATGCCTTCG
    CCGCAGGAGG

401 GTGTTCAAAA ATATTTTTGG TTTATGGGTT TCAGCGAAAA
    AAGCGGCGGG

451 TTGATACGCG AACGTGATTA CTGCGAAGCC GTCCGTTTCG
    ATACTGAAGC

501 CCTGCGAGAG CGGCTGATGC TGCCCGAAAA AAACGCCTCC
    GAATGGCTGC

551 TTTTCGGCTA TCGGAGCGAT GTTTGGGCAA AGTGGCTGGA
    AATGTGGCGA

601 CAGGCAGGCA GCCCGATGAC ACTGTTGCTG GCGGGGACGC
    AAATCATCGA

651 CAGCCTCAAA CAAAGCGGCG TTATTCCGCA AGATGCCCTG
    CAAAACGACG

701 GCGATGTTTT TCAGACGGCA TCCGTCCGCC TCGTCAAAAT
    CCCTTTCGTG

751 CCGCAACAGG ACTTCGACCA ACTGCTGCAC CTTGCCGACT
    GCGCCGTCAT
```

```
-continued
 801 CCGCGGCGAA GACAGTTTCG TGCGCGCCCA GCTTGCGGGC
      AAACCCTTCT
 851 TTTGGCACAT CTACCCGCAA GACGAGAATG TCCATCTCGA
      CAAACTCCAC
 901 GCCTTTTGGG ATAAGGCACA CGGTTTCTAC ACGCCCGAAA
      CCGTGTCGGC
 951 ACACCCCCGT CTTTCGGACG ACCTCAACGG CGGAGAGGCT
      TTATCCGCAA
1001 CACAACGCCT CGAATGTTGG CAAACCCTGC AACAACATCA
      AAACGGCTGG
1051 CGGCAAGGCG CGGAGGATTG GAGCCGTTAT CTTTTCGGGC
      AGCCGTCAGC
1101 TCCTGAAAAA CTCGCTGCCT TTGTTTCAAA GCATCAAAAA
      ATACGCTAG
```

This corresponds to the amino acid sequence <SEQ ID 190; ORF32-1>:

```
  1 MNTPPFVCWI FCKVIDNFGD IGVSWRLARV LHRELGWQVH
    LWTDDVSALR
 51 ALCPDLPDVP CVHQDIHVRT WHSDAADIDT AFVPDVVIET
    FACDLPENVL
101 HIIRRHKPLW LNWEYLSAEE SNERLHLMPS PQEGVQKYFW
    FMGESEKSGG
151 LIRERDYCEA VRFDTEALRE RLMLPEKNAS EWLLFGYRSD
    VWAKWLEMWR
201 QAGSPMTLLL AGTQIIDSLK QSGVIFQDAL QNDGDVFQTA
    SVRLVKIPFV
251 PQQDFDQLLH LADCAVIRGE DSFVRAQLAG KPFFWHIYPQ
    DENVHLDKLH
301 AFWDKAHGFY TPETVSAHRR LSDDLNCGEA LSATQRLECW
    QTLQQHQNGW
351 RQGAEDWSRY LFGQPSAPEK LAAFVSKHQK IR*w
```

Computer analysis of this amino acid sequence gave the following results:

Homology with a Predicted ORF from *N. meningitidis* (Strain A)

ORF32 shows 93.8% identity over a 81aa overlap with an ORF (ORF32a) from strain A of *N. meningitidis*:

The complete length ORF32a nucleotide sequence <SEQ ID 191> is:

```
  1 ATGAATACTC CTCCTTTTTC TGCTGGANTT TTTTGCAAGG
    TCATCGACAA
 51 TTTCGGCGAC ATCGGCGTTT CGTGGCGGCT TGCCCGTGTT
    TTGCACCGCG
101 AACTCGGTTG GCAGGTGCAT TTGTGGACGG ACGATGTGTC
    CGCCTTGCGT
151 GCGCTTTGCC CTGATTTGCC CGATGTTCNC TGCGTTCATC
    AGGATATTCA
201 TGTCCGCACT TGGCATTCCG ATGCGGCAGA TATTGATACC
    GCGCCTGTTC
251 NCGATGTCGT CATCGAAACT TTTGCCTGCG ACCTGCCCGA
    AAATGTGCTG
301 CACATCATCC GCCGACACAA GCCGCTTTGG CTGAANTGGG
    AATATTTGAG
351 CGCGGAGGAN AGCAATGAAA GGCTGCACNT GATGCCTTCG
    CCGCAGGAGA
401 GTGTTCNAAA ATANTTTTGG TTTATGGGTT TCAGCGAANN
    NAGCGGCGGA
451 CTGATACGCG AACGCGATTA CTGCGAAGCC GTCCGTTTCG
    ATAGCGGAGC
501 CTTGCGCAAG AGGCTGATGC TTCCCGAAAA AAACGNCCCC
    GAATGGCTGC
551 TTTTCGGCTA TCGGAGCGAT GTTTGGGCAA GTGGCTGGA
    AATGTGGCGA
601 CAGGCAGGCA GTCCGTTGAC ACTTTTGCTG GCNGGGGCGC
    ANATTATCGA
651 CAGCCTCAAA CAAAACGGCG TTATTCCGCA AGATGCCCTG
    CAAAACGACG
701 GCGATGTTTT TCAGACGGCA TCCGTCCGCC TCCTCAAAAT
    CCCTTTCGTG
751 CCGCAACAGG ACTTCGACAA ACTGCTGCAC CTTGCCGACT
    GCGCCGTCAT
801 CCGCGGCGAA GACAGTTTCG TGCGCGCCCA GCTTGCGGGC
    AAACCCTTCT
851 TTTGGCACAT CTACCCGCAA GATGAGAATG TCCATCTCGA
    CAAACTCCAC
901 GCCTTTTGGG ATAAGGCACA CGGTTTCTAC ACGCCCGAAA
    CCGCATCGGC
```

```
                10        20        30        40        50        60
  orf32.pep    MNTPPFVCWIFCKVIDNFGDIGVSWRLARVLHRELGWQVHLWTDDVSALRALCPDLPDVP
                ||||||    ||||||||||||||||||||||||||||||||||||||||||||||||||
  orf32a       MNTPPFSAGXFCKVIDNFGDIGVSWRLARVLHRELGWQVHLWTDDVSALRALCPDLPDVX
                10        20        30        40        50        60

70        80
  orf32.pep    CVHQDIHVRTWHSDAADIDTA
                |||||||||||||||||||||
  orf32a       CVHQDIHVRTWHSDAADIDTAPVXDVVIETFACDLPENVLHIIRRHKPLWLXWEYLSAEX
                70        80        90       100       110       120
```

-continued

```
 951 ACACCGCCGC CTTTCAGACG ACCTCAACGG CGGAGAGGCT
     TTATCCGCAA

1001 CACAACGCCT CGAATGTTGG CAAATCCTGC AACAACATCA
     AAACGGCTGG

1051 CGGCAAGGCG CGGAGGATTG GAGCCGTTAT CTTTTTGGGC
     AGCCTTCCGC

1101 ATCCGAAAAA CTCGCCGCCT TTGTTTCAAA GCATCAAAAA
     ATACGCTAG
```

This encodes a protein having amino acid sequence <SEQ ID 192>:

```
  1 MNTPPFSAGX FCKVIDNFGD IGVSWRLARV LHRELGWQVH
    LWTDDVSALR

51 ALCPDLPDVX CVHQDIHVRT WHSDAADIDT APVXDVVIET
    FACDLPENVL

101 HIIRRHKPLW LXWEYLSAEX SNERLHXMPS PQESVXKXFW
    FMGFSEXSGG

151 LIRERDYCEA VRFDSGALRK RLMLPEKNXP EWLLFGYRSD
    VWAKWLEMWR

201 QAGSPLTLLL AGAXIIDSLK QNGVIPQDAL QNDGDVFQTA
    SVRLVKIPFV

251 PQQDFDKLLH LADCAVIRGE DSFVRAQLAG KPFFWHIYPQ
    DENVHLDKLH

301 AFWDKAHGFY TPETASAHRR LSDDLNGGEA LSATQRLECW
    QILQQHQNGW

351 RQGAEDWSRY LFGQPSASEK LAAFVSKHQK IR*
```

ORF32a and ORF32-1 show 93.2% identity in 382 aa overlap:

```
                  10        20        30        40        50        60
orf32-1.pep  MNTPPFVCWIFCKVIDNFGDIGVSWRLARVLHRELGWQVHLWTDDVSALRALCPDLPDVP
             ||||||  |||||||||||||||||||||||||||||||||||||||||||||||||||
orf32a       MNTPPFSAGXFCKVIDNFGDIGVSWRLARVLHRELGWQVHLWTDDVSALRALCPDLPDVX
                  10        20        30        40        50        60

70        80        90       100       110       120
orf32-1.pep  CVHQDIHVRTWHSDAADIDTAPVPDVVIETFACDLPENVLHIIRRHKPLWLNWEYLSAEE
             |||||||||||||||||||||||| ||||||||||||||||||||||||||| ||||||
orf32a       CVHQDIHVRTWHSDAADIDTAPVXDVVIETFACDLPENVLHIIRRHKPLWLXWEYLSAEX
                  70        80        90       100       110       120

130       140       150       160       170       180
orf32-1.pep  SNERLHLMPSPQEGVQKYFWFMGFSEKSGGLIRERDYCEAVRFDTEALRERLMLPEKNAS
             ||||||  ||||| :  | ||||||||| |||||||||||||||: |||:|||||||| 
orf32a       SNERLHXMPSPQESVXKXFWFMGFSEXSGGLIRERDYCEAVRFDSGALRKRLMLPEKNXP
                 130       140       150       160       170       180

190       200       210       220       230       240
orf32-1.pep  EWLLFGYRSDVWAKWLEMWRQAGSPMTLLLAGTQIIDSLKQSGVIPQDALQNDGDVFQTA
             |||||||||||||||||||||||||:|||||:||||||:||||||||||||||||||||
orf32a       EWLLFGYRSDVWAKWLEMWRQAGSPLTLLLAGAXIIDSLKQNGVIPQDALQNDGDVFQTA
                 190       200       210       220       230       240

250       260       270       280       290       300
orf32-1.pep  SVRLVKIPFVPQQDFDQLLHLADCAVIRGEDSFVRAQLAGKPFFWHIYPQDENVHLDKLH
             ||||||||||||||||:|||||||||||||||||||||||||||||||||||||||||
orf32a       SVRLVKIPFVPQQDFDKLLHLADCAVIRGEDSFVRAQLAGKPFFWHIYPQDENVHLDKLH
                 250       260       270       280       290       300

310       320       330       340       350       360
orf32-1.pep  AFWDKAHGFYTPETVSAHRRLSDDLNGGEALSATQRLECWQTLQQHQNGWRQGAEDWSRY
             ||||||||||||||:|||||||||||||||||||||||||| ||||||||||||||||
orf32a       AFWDKAHGFYTPETASAHRRLSDDLNGGEALSATQRLECWQILQQHQNGWRQGAEDWSRY
                 310       320       330       340       350       360

370       380
orf32-1.pep  LFGQPSAPEKLAAFVSKHQKIRX
             ||||||| |||||||||||||||
orf32a       LFGQPSASEKLAAFVSKHQKIRX
                 370       380
```

Homology with a Predicted ORF from *N. gonorrhoeae*

ORF32 shows 95.1% identity over a 82aa overlap with a predicted ORF (ORF32.ng) from *N. gonorrhoeae*:

```
orf32.pep    MNTPPF-VCWIFCKVIDNFGDIGVSWRLARVLHRELGWQVHLWTDDVSALRALCPDLP      57
             ||| | ||||||||||||||||||||||||||||||||||||||||||||||||||
orf32ng      MVMNTYAFPVCWIFCKVIDNFGDIGVSWRLARVLHRELGWQVHLWTDDVSALRALCPDLP    60 orf32.pep    DVPCVHQDIHVRTWHSDAADIDTA                                        81
             ||| ||||||||||||||||||||
orf32ng      DVPFVHQDIHVRTWHSDAADIDTAPVPDAVIETFACDLPENVLNIIRRHKPLWLNWEYLS   120
```

An ORF32ng nucleotide sequence <SEQ ID 193> was predicted to encode a protein having amino acid sequence <SEQ ID 194>:

```
  1  MVMNTYAFPV CWIFCKVIDN FGDIGVSWRL ARVLHRELGW
     QVHLWTDDVS

51  ALRALCPDLP DVPFVHQDIH VRTWHSDAAD IDTAPVPDAV
     IETFACDLPE

101  NVLNIIRRHK PLWLNWEYLS AEESNERLHL MPSPQEGVQK
     YFWFMGFSEK

151  SGGLIRERDY REAVRFDTEA LRRRLVLPEK NAPEWLLFGY
     RGDVWAKWLD

201  MWQQAGSLMT LLLAGAQIID SLKQSGVIPQ NALQNEGGVF
     QTASVRLVKI

251  PFVPQQDFDK LLHLADCAVI RGEDSEVRTQ LAGKPFFWHI
     YPQDENVHLD

301  KLHAFWDKAY GFYTPETASV HRLLSDDLNG GEALSATQRL
     ECGVL*
```

Further sequencing revealed the following DNA sequence <SEQ ID 195>:

```
   1  ATGAATACAT ACGCTTTTCC TGTCTGTTGG ATTTTTTGCA
      AGGTCATCGA

51  CAATTTCGGC GACATCGGCG TTTCGTGGCG GCTCGCCCGT
      GTTTTGCACC

101  GCGAACTCGG TTGGCAGGTG CATTTGTGGA CGGACGACGT
      GTCCGCCTTG

151  CGCGCGCTTT GTCCCGATTT GCCCGATGTT CCCTTCGTTC
      ATCAGGATAT

201  TCATGTCCGC ACTTGGCATT CCGATGCGGC AGACATTGAT
      ACCGCGCCCG

251  TTCCCGATGC CGTTATCGAA ACTTTTGCCT GCGACCTGCC
      CGAAAATGTG

301  CTGAACATCA TCCGCCGACA CAAACCGCTT TGGCTGAATT
      GGGAATATTT

351  GAGCGCGGAG GAAAGCAATG AAAGGCTGCA CCTGATGCCT
      TCGCCGCAGG

401  AGGGCGTTCA AAAATATTTT TGGTTTATGG GTTTCAGCGA
      AAAAAGCGGC

451  GGGTTGATAC GCGAACGCGA TTACCGCGAA GCCGTCCGTT
      TCGATACCGA

501  AGCCCTGCGC CGGCGGCTGG TGCTGCCCGA AAAAAACGCC
      CCCGAATGGC

551  TGCTTTTCGG CTATCGGGGC GATGTTTGGG CAAAGTGGCT
      GGACATGTGG
```

```
 601  CAACAGGCAG GCAGCCTGAT GACCCTACTG CTGGCGGGGG
      CGCAAATTAT

651  CGACAGCCTC AAACAAAGCG GCGTTATTCC GCAAAACGCC
      CTGCAAAAtg 701  aaggcgGTGT CTTTCagacG gcatccgTcC gccttGTCAA
      AAtcCCGTTC 751  GTGCcGCAAC AGGAcTTCGA CAAATTGCTG CAcctcgcCG
      ACTGCGCCGT

801  GATACGCGGC GAAGACAGTT TCGTGCGTAC CCAGCTTGCC
      GGAAAACCCT

851  TTTTTTGGCA CATCTACCCG CAAGACGAGA ATGTCCATCT
      CGACAAACTC

901  CACGCCTTTT GGGATAAGGC ATACGGCTTC TACACGCCCG
      AAACCGCATC

951  GGTGCACCGC CTCCTTTCGG ACGACCTCAA CGGCGGAGAG
      GCTTTATCCG

1001  CAACACAACG CCTCGAATGT TGGCAAACCC TGCAACAACA
      TCAAAACGGC

1051  TGGCGGCAAG GCGCGGAGGA TTGGAGCCGT TATCTTTTCG
      GGCAGCCTTC

1101  CGCATCCGAA AAACTCGCCG CCTTTGTTTC AAAGCATCAA
      AAAATACGCT

1151  AG
```

This encodes a protein having amino acid sequence <SEQ ID 196; ORF32ng-1>:

```
  1  MNTYAFPVCW IFCKVTDNFG DIGVSWRLAR VLHRELGWQV
     HLWTDDVSAL

51  RALCPDLPDV PFVHQDIHVR TWHSDAADID TAPVPDAVIE
     TFACDLPENV

101  LNIIRRHKPL WLNWEYLSAE ESNERLHLMP SPQEGVQKYF
     WFMGFSEKSG

151  GLIRERDYRE AVRFDTEALR RRLVLPEKNA PEWLLFGYRG
     DVWAKWLDMW

201  QQAGSLMTLL LAGAQIIDSL KQSGVIPQNA LQNEGGVFQT
     ASVRLVKIPF

251  VPQQDFDKLL HLADCAVIRG EDSFVRTQLA GKPFFWHIYP
     QDENVHLDKL

301  HAFWDKAYGF YTPETASVER LLSDDLNGGE ALSATQRLEC
     WQTLQQHQNG

351  WRQGAEDWSR YLFGQPSASE KLAAFVSKHQ KIR*
```

ORF32ng-1 and ORF32-1 show 93.5% identity in 383 aa overlap:

```
                       10        20        30        40        50       59
orf32-1.pep    MNTPPF-VCWIFCKVIDNFGDIGVSWRLARVLHRELGWQVHLWTDDVSALRALCPDLPDV
               ||| | ||||||||||||||||||||||||||||||||||||||||||||||||||||
orf32ng-1      MNTYAFPVCWIFCKVIDNFGDIGVSWRLARVLHRELGWQVHLWTDDVSALRALCPDLPDV
                       10        20        30        40        50       60

60        70        80        90       100       110       119
orf32-1.pep    PCVHQDIHVRTWHSDAADIDTAPVPDVVIETFACDLPENVLHIIRRHKPLWLNWEYLSAE
               | |||||||||||||||||||||||||||:|||||||||||||:||||||||||||||||
orf32ng-1      PFVHQDIHVRTWHSDAADIDTAPVPDAVIETFACDLPENVLNIIRRHKPLWLNWEYLSAE
                       70        80        90       100       110       120

120       130       140       150       160       170       179
orf32-1.pep    ESNERLHLMPSPQEGVQKYFWFMGFSEKSGGLIRERDYCEAVRFDTEALRERLMLPEKNA
               ||||||||||||||||||||||||||||||||||||||| |||||||||||:||:||||||
orf32ng-1      ESNERLHLMPSPQEGVQKYFWFMGFSEKSGGLIRERDYREAVRFDTEALRRLVLPEKNA
                      130       140       150       160       170       180

180       190       200       210       220       230       239
orf32-1.pep    SEWLLFGYRSDVWAKWLEMWRQAGSPMTLLLAGTQIIDSLKQSGVIPQDALQNDGDVFQT
               ||||||||:||||||||:||:||||  ||||||:|||||||||||||:||||:| ||||
orf32ng-1      PEWLLFGYRGDVWAKWLDMWQQAGSLMTLLLAGAQIIDSLKQSGVIPQNALQNEGGVFQT
                      190       200       210       220       230       240

240       250       260       270       280       290       299
orf32-1.pep    ASVRLVKIPFVPQQDFDQLLHLADCAVIRGEDSFVRAQLAGKPFFWHIYPQDENVHLDKL
               |||||||||||||||||:|||||||||||||||||:|||||||||||||||||||||||
orf32ng-1      ASVRLVKIPFVPQQDFDKLLHLADCAVIRGEDSFVRTQLAGKPFFWHIYPQDENVHLDKL
                      250       260       270       280       290       300

300       310       320       330       340       350       359
orf32-1.pep    HAFWDKAHGFYTPETVSAHRRLSDDLNGGEALSATQRLECWQTLQQHQNGWRQGAEDWSR
               ||||||:||||||:|:||||||||||||||||||||||||||||||||||||||||
orf32ng-1      HAFWDKAYGFYTPETASVHRLLSDDLNGGEALSATQRLECWQTLQQHQNGWRQGAEDWSR
                      310       320       330       340       350       360

360       370       380
orf32-1.pep    YLFGQPSAPEKLAAFVSKHQKIRX
               ||||||||  ||||||||||||||
orf32ng-1      YLFGQPSASEKLAAFVSKHQKIRX
                      370       380
```

On this basis, including the RGD sequence in the gonococcal protein, characteristic of adhesins, it is predicted that the proteins from N. meningitidis and N. gonorrhoeae, and their epitopes, could be useful antigens for vaccines or diagnostics, or for raising antibodies.

ORF32-1 (42 kDa) was cloned in pET and pGex vectors and expressed in E. coli, as described above. The products of protein expression and purification were analyzed by SDS-PAGE. FIG. 7A shows the results of affinity purification of the His-fusion protein, and FIG. 7B shows the results of expression of the GST-fusion in E. coli. Purified His-fusion protein was used to immunise mice, whose sera were used for ELISA, giving a positive result. These experiments confirm that ORF32-1 is a surface-exposed protein, and that it is a useful immunogen.

Example 24

The following partial DNA sequence was identified in N. meningitidis <SEQ ID 197>:

```
  1..TTGTTCCTGC GTGTNAAAGT GGGGCGTTTT TTCAGCAGTC CGGCGACGTG

51  GTTTCGGGNC AAAGACCCTG TAAATCAGGC GGTGTTGCGG CTGTATNCGG

101  ACGAGTGGCG GCA.ACTTCG GTACGTTGGA AAATAGNCGC AACGTCGCAC

151  AGCCTGTGGC TCTGCACGCT GCTCGGAATG CTGGTGTCGG TATTGTTGCT

201  GCTTTTGGTG CGGCAATATA CGTTCAACTG GGAAAGCACG CTGTTGAGCA

251  ATGCCGCTTC GGTACGCGCG GTGGAAATGT TGGCATGGCT GCCGTCGAAA

301  CTCGGTTTCC CTGTCCCCGA TGCGCGGTCG GTCATCGAAG GCCGTCTGAA

351  CGGCAATATT GCCGATGCGC GGGCTTGGTC GGGGCTGCTG GTCGNCAGTA

401  TCGCCTGCTA NGGCATCCTG CCGCGCCTG..
```

This corresponds to the amino acid sequence <SEQ ID 198; ORF33>:

```
  1..LFLRVKVGRF FSSPATWFRX KDPVNQAVLR LYXDEWRXTS VRWKIXATSH

51 SLWLCTLLGM LVSVLLLLLV RQYTFNWEST LLSNAASVRA VEMLAWLPSK

101 LGFPVPDARS VIEGRLNGNI ADARAWSGLL VXSIACXGIL PRL..
```

Further work revealed the complete nucleotide sequence <SEQ ID 199>:

```
   1 ATGTTGAATC CATCCCGAAA ACTGGTTGAG CTGGTCCGTA TTTTGGACGA

51 AGGCGGTTTT ATTTTCAGCG GCGATCCCGT ACAGGCGACG GAGGCTTTGC

101 GCCGCGTGGA CGGCAGTACG GAGGAAAAAA TCATCCGTCG GGCGGAGATG

151 ATTGACAGGA ACCGTATGCT GCGGGAGACG TTGGAACGTG TGCGTGCGGG

201 GTCGTTCTGG TTGTGGGTGG TGGCGGCGAC GTTTGCATTT TTTACCGGTT

251 TTTCAGTCAC TTATCTTCTA ATGGACAATC AGGGTCTGAA TTTCTTTTTG

301 GTTTTGGCGG GCGTGTTGGG CATGAATACG CTGATGCTGG CAGTATGGTT

351 GGCAATGTTG TTCCTGCGTG TGAAAGTGGG GCGTTTTTTC AGCAGTCCGG

401 CGACGTGGTT TCGGGCAAA GACCCTGTAA ATCAGGCGGT GTTGCGGCTG

451 TATGCGGACG AGTGGCGGCA ACCTTCGGTA CGTTGGAAAA TAGGCGCAAC

501 GTCGCACAGC CTGTGGCTCT GCACGCTGCT CGGAATGCTG GTGTCGGTAT

551 TGTTGCTGCT TTTGGTGCGG CAATATACGT TCAACTGGGA AAGCACGCTG

601 TTGAGCAATG CCGCTTCGGT ACGCGCGGTG GAAATGTTGG CATGGCTGCC

651 GTCGAAACTC GGTTTCCCTG TCCCCGATGC GCGGGCGGTC ATCGAAGGCC

701 GTCTGAACGG CAATATTGCC GATGCGCGGG CTTGGTCGGG GCTGCTGGTC

751 GGCAGTATCG CCTGCTACGG CATCCTGCCG CGCCTGCTGG CTTGGGTAGT

801 GTGTAAAATC CTTTTGAAAA CAAGCGAAAA CGGATTGGAT TTGGAAAAGC

851 CCTATTATCA GGCGGTCATC CGCCGCTGGC AGAACAAAAT CACCGATGCG

901 GATACGCGTC GGGAAACCGT GTCCGCCGTT TCACCGAAAA TCATCTTGAA

951 CGATGCGCCG AAATGGGCGG TCATGCTGGA GACCGAGTGG CAGGACGGCG

1001 AATGGTTCGA GGGCAGGCTG GCGCAGGAAT GGCTGGATAA GGGCGTTGCC

1051 ACCAATCGGG AACAGGTTGC CGCGCTGGAG ACAGAGCTGA AGCAGAAACC

1101 GGCGCAACTG CTTATCGGCG TGCGCGCCCA AACTGTGCCG GACCGCGGCG

1151 TGTTGCGGCA GATTGTCCGA CTCTCGGAAG CGGCCCAGGG CGGCGCGGTG

1201 GTGCAGCTTT TGGCGGAACA GGGGCTTTCA GACGACCTTT CGGAAAAGCT

1251 GGAACATTGG CGTAACGCGC TGGCCGAATG CGGCGCGGCG TGGCTTGAGC

1301 CTGACAGGGC GGCGCAGGAA GGGCGTTTGA AAGACCAATA A
```

This corresponds to the amino acid sequence <SEQ ID 200; ORF33-1>:

```
  1 MLNPSRKLVE LVRILDEGGF IFSGDPVQAT EALRRVDGST EEKIIRRAEM

51 IDRNRMLRET LERVRAGSFW LWVVAATFAF FTGFSVTYLL MDNQGLNFFL
```

-continued

```
101 VLAGVLGMNTLMLAVWLAML FLRVKVGRFF SSPATWFRGK DPVNQAVLRL

151 YADEWRQPSV RWKIGATSHS LWLCTLLGML VSVLLLLLVR QYTFNWESTL

201 LSNAASVRAV EMLAWLPSKL GFPVPDARAV IEGRLNGNIA DARAWSGLLV

251 GSIACYGILP RLLAWVVCKI LLKTSENGLD LEKPYYQAVI RRWQNKITDA

301 DTRRETVSAV SPKIILNDAP KWAVMLETEW QDGEWFEGRL AQEWLDKGVA

351 TNREQVAALE TELKQKPAQL LIGVRAQTVP DRGVLRQIVR LSEAAQGGAV

401 VQLLAEQGLS DDLSEKLEHW RNALAECGAA WLEPDRAAQE GRLKDQ*
```

Computer analysis of this amino acid sequence gave the following results:

Homology with a Predicted ORF from *N. meningitidis* (Strain A)

ORF33 shows 90.9% identity over a 143aa overlap with an ORF (ORF33a) from strain A of *N. meningitidis*:

```
                                                  10        20        30
        orf33.pep                         LFLRVKVGRFFSSPATWFRXKDPVNQAVLR
                                          ||||||||||||||||||| ||||||||||
        orf33a      LMDNQGLNFFLVLAGVXGMNTLMLAVWLAMLFLRVKVGRFFSSPATWFRGKDPVNQAVLR
                    90        100       110       120       130       140
                            40        50        60        70        80        90
        orf33.pep   LYXDEWRXTSVRWKIXATSHSLWLCTLLGMLVSVLLLLLVRQYTFNWESTLLSNAASVRA
                    ||  |||||  ||||| |||||||||||||||||||||||||||||||||||::::|||
        orf33a      LYADEWRXPSVRWKIGATSHSLWLCTLLGMLVSVLLLLLVRQYTFNWESTLLGDSSSVRL
                    150       160       170       180       190       200
                            100       110       120       130       140
        orf33.pep   VEMLAWLPSKLGFPVPDARSVIEGRLNGNIADARAWSGLLVXSIACXGILPRL
                    |||||||||:|||||||||||:|||||||||||||||||||| |||| ||||||
        orf33a      VEMLAWLPAKLGFPVPDARAVIEGRLNGNIADARAWSGLLVGSIACYGILPRLLAWAVCK
                    210       220       230       240       250       260
        orf33a      ILXXTSENGLDLEKXXXXXXIRRWQNKITDADTRRETVSAVSPKIVLNDAPKWAVMLETE
                    270       280       290       300       310       320
```

The complete length ORF33a nucleotide sequence <SEQ ID 201> is:

```
  1 ATGTTGAATC CATCCCGAAA ACTGGTTGAG CTGGTCCGTA TTTTGGAAGA

51 AGGCGGCTTT ATTTTCAGCG GCGATCCCGT GCAGGCGACG GAGGCTTTGC

101 GCCGCGTGGA CGGCAGTACG GAGGAAAAAA TCATCCGTCG GGCGAAGATG

151 ATCGACAGGA ACCGTATGCT GCGGGAGACG TTGGAACGTG TGCGTGCGGG

201 GTCGTTCTGG TTGTGGGTGG CGGCGGCGAC GTTTGCGTTT NTTACCGNTT

251 TTTCAGTTAC TTATCTTCTA ATGGACAATC AGGGTCTGAA TTTCTTTTTG

301 GTTTTGGCGG GCGTGNTGGG CATGAATACG CTGATGCTGG CAGTATGGTT

351 GGCAATGTTG TTCCTGCGCG TGAAAGTGGG GCGTTTTTTC AGCAGTCCGG

401 CGACGTGGTT TCGGGGCAAA GACCCTGTCA ATCAGGCGGT GTTGCGGCTG

451 TATGCGGACG AGTGGCGGCN ACCTTCGGTA CGTTGGAAAA TAGGCGCAAC

501 GTCGCACAGC CTGTGGCTCT GCACGCTGCT CGGAATGCTG GTGTCGGTAT

551 TGTTGCTGCT TTTGGTGCGG CAATATACGT TCAACTGGGA AAGCACGCTG

601 TTGGGCGATT CGTCTTCGGT ACGGCTGGTG GAAATGTTGG CATGGCTGCC
```

-continued

```
 651 TGCGAAACTG GGTTTTCCCG TGCCTGATGC GCGGGCGGTC ATCGAAGGTC
 701 GTCTGAACGG CAATATTGCC GATGCGCGGG CTTGGTCGGG GCTGCTGGTC
 751 GGCAGTATCG CCTGCTACGG CATCCTGCCG CGCCTCTTGG CTTGGGCGGT
 801 ATGCAAAATC CTTNTGNAAA CAAGCGAAAA CGGCTTGGAT TTGGAAAAGC
 851 NCNNNNNTCN NNCGNTCATC CGCCGCTGGC ACAACAAAAT CACCGATGCG
 901 GATACGCGTC GGGAAACCGT GTCCGCCGTT TCGCCGAAAA TCGTCTTGAA
 951 CGATGCGCCG AAATGGGCGG TCATGCTGGA GACCGAATGG CAGGACGGCG
1001 AATGGTTCGA GGGCAGGCTG GCGCAGGAAT GGCTGGATAA GGGCGTTGCC
1051 GCCAATCGGG AACAGGTTGC CGCGCTGGAG ACAGAGCTGA AGCAGAAACC
1101 GGCGCAACTG CTTATCGGCG TGCGCGCCCA AACTGTGCCC GACCGCGGCG
1151 TGTTGCGGCA GATCGTCCGA CTTTCGGAAG CGGCGCAGGG CGGCGCGGTG
1201 GTGCANCTTT TGGCGGAACA GGGGCTTTCA GACGACCTTT CGGAAAAGCT
1251 GGAACATTGG CGTAACGCGC TGACCGAATG CGGCGCGGCG TGGCTGGAAC
1301 CCGACAGAGC GGCGCAGGAA GGCCGTCTGA AAACCAACGA CCGCACTTGA
```

This encodes a protein having amino acid sequence <SEQ ID 202>:

```
  1 MLNPSRKLVE LVRILEEGGF IFSGDPVQAT EALRRVDGST EEKIIRRAKM
 51 IDRNRMLRET LERVRAGSFW LWVAAATFAF XTXFSVTYLL MDNQGLNFFL
101 VLAGVXGMNT LMLAVWLAML FLRVKVGRFF SSPATWFRGK DPVNQAVLRL
151 YADEWRXPSV RWKIGATSHS LWLCTLLGML VSVLLLLLVR QYTFNWESTL
201 LGDSSSVRLV EMLAWLPAKL GFPVPDARAV IEGRLNGNIA DARAWSGLLV
251 GSIACYGILP RLLAWAVCKI LXXTSENGLD LEKXXXXXXI RRWQNKITDA
301 DTRRETVSAV SPKIVLNDAP KWAVMLETEW QDGEWFEGRL AQEWLDKGVA
351 ANREQVAALE TELKQKPAQL LIGVRAQTVP DRGVLRQIVR LSEAAQGGAV
401 VXLLAEQGLS DDLSEKLEHW RNALTECGAA WLEPORAAQE GRLKTNDRT*
                                                      45
```

ORF33a and ORF33-1 show 94.1% identity in 444 aa overlap:

```
                    10         20         30         40         50         60
orf33a.pep  MLNPSRKLVELVRILEEGGFIFSGDPVQATEALRRVDGSTEEKIIRRAKMIDRNRMLRET
            ||||||||||||||| :||||||||||||||||||||||||||||| :||||||||||||
orf33-1     MLNPSRKLVELVRILDEGGFIFSGDPVQATEALRRVDGSTEEKIIRRAEMIDRNRMLRET
                    10         20         30         40         50         60

70         80         90        100        110        120
orf33a.pep  LERVRAGSFWLWVAAATFAFXTXFSVTYLLMDNQGLNFFLVLAGVXGMNTLMLAVWLAML
            ||||||||||||| :||||||     ||||||||||||||||||||:|||||||||||||
orf33-1     LERVRAGSFWLWVVAATFAFFTGFSVTYLLMDNQGLNFFLVLAGVLGMNTLMLAVWLAML
                    70         80         90        100        110        120

130        140        150        160        170        180
orf33a.pep  FLRVKVGRFFSSPATWFRGKDPVNQAVLRLYADEWRXPSVRWKIGATSHSLWLCTLLGML
            ||||||||||||||||||||||||||||||||||||| ||||||||||||||||||||||
orf33-1     FLRVKVGRFFSSPATWFRGKDPVNQAVLRLYADEWRQPSVRWKIGATSHSLWLCTLLGML
                   130        140        150        160        170        180

190        200        210        220        230        240
orf33a.pep  VSVLLLLLVRQYTFNWESTLLGDSSSVRLVEMLAWLPAKLGFPVPDARAVIEGRLNGNIA
            ||||||||||||||||||||| : ::|||:|||||||||:||||||||||||||||||||
orf33-1     VSVLLLLLVRQYTFNWESTLLSNAASVRAVEMLAWLPSKLGFPVPDARAVIEGRLNGNIA
                   190        200        210        220        230        240
```

```
                      250        260        270        280        290        300
orf33a.pep   DARAWSGLLVGSIACYGILPRLLAWAVCKILXXTSENGLDLEKXXXXXXIRRWQNKITDA
             ||||||||||||||||||||||||||||:||||  ||||||||||      ||||||||||||
orf33-1      DARAWSGLLVGSIACYGILPRLLAWVVCKILLKTSENGLDLEKPYYQAVIRRWQNKITDA
                      250        260        270        280        290        300
                      310        320        330        340        350        360
orf33a.pep   DTRRETVSAVSPKIVLNDAPKWAVMLETEWQDGEWFEGRLAQEWLDKGVAANREQVAALE
             |||||||||||||:||||||||||||||||||||||||||||||||||||||:|||||||
orf33-1      DTRRETVSAVSPKIILNDAPKWAVMLETEWQDGEWFEGRLAQEWLDKGVATNREQVAALE
                      310        320        330        340        350        360
                      370        380        390        400        410        420
orf33a.pep   TELKQKPAQLLIGVRAQTVPDRGVLRQIVRLSEAAQGGAVVXLLAEQGLSDDLSEKLEHW
             ||||||||||||||||||||||||||||||||||||||||||| |||||||||||||||||
orf33-1      TELKQKPAQLLIGVRAQTVPDRGVLRQIVRLSEAAQGGAVVQLLAEQGLSDDLSEKLEHW
                      370        380        390        400        410        420
                      430        440        450
orf33a.pep   RNALTECGAAWLEPDRAAQEGRLKTNDRTX
             ||||:||||||||||||||||||||| ||
orf33-1      RNALAECGAAWLEPDRAAQEGRLKDQX
                      430        440
```

Homology with a Predicted ORF from *N. gonorrhoeae*

ORF33 shows 91.6% identity over a 143aa overlap with a predicted ORF (ORF33.ng) from *N. gonorrhoeae*:

```
orf33.pep                          LFLRVKVGRFFSSPATWFRXKDPVNQAVLR    30
                                   ||||||||||||||||||||||| ||||||||
orf33ng    LMDNQGLNFFLVLAGVLGMNTLMLAVWLATLFLRVKVGRFFSSPATWFRGKGPVNQAVLR   100
orf33.pep  LYXDEWRXTSVRWKIXATSHSLWLCTLLGMLVSVLLLLLVRQYTFNWESTLLSNAASVRA    90
           || |:|| ||||||  |:||||||||||||||||||||||||||||||||||||||||||
orf33ng    LYADQWRQPSVRWKIGATAHSLWLCTLLGMLVSVLLLLLVRQYTFNWESTLLSNAASVRA   160
orf33.pep  VEMLAWLPSKLGFPVPDARSVIEGRLNGNIADARAWSGLLVXSIACXGILPRL           143
           |||||||||||||||||||||:||||||||||||||||||||| ||:|||||||
orf33ng    VEMLAWLPSKLGFPVPDARAVIEGRLNGNIADARAWSGLLVGSIVCYGILPRLLAWVVCK   220
```

An ORF33ng nucleotide sequence <SEQ ID 203> was predicted to encode a protein having amino acid sequence <SEQ ID 204>:

```
  1  MIDRDRMLRD TLERVRAGSF WLWVVVASMM FTAGFSGTYL LMDNQGLNFF

51  LVLAGVLGMN TLMLAVWLAT LFLRVKVGRF FSSPATWFRG KGPVNQAVLR

101  LYADQWRQPS VRWKIGATAH SLWLCTLLGM LVSVLLLLLV RQYTFNWEST

151  LLSNAASVRA VEMLAWLPSK LGFPVPDARA VIEGRLNGNI ADARAWSGLL

201  VGSIVCYGIL PRLLAWVVCK ILLKTSENGL DLEKYYQAV  IRRWQNKITD

251  ADTRRETVSA VSPKIVLNDA PKWALMLETE WQDGQWFEGR LAQEWLDKGV

301  AANREQVAAL ETELKQKPAQ LLIGVRAQTV PDRGVLRQIV RLSEAAQGGA

351  VVQLLAEQGL SDDLSEKLEH WRNALTECGA AWLEPDRVAQ EGRLKDQ*
```

Further sequence analysis revealed the following DNA sequence <SEQ ID 205>:

```
  1  ATGTTGaatC CATCCCgaAA ACTGgttgag ctGgTCCgtA Ttttgaataa 51  aggggtTTT  attttcagcg gcgatcctgt gcaggcgacg gaggctttgc 101  gccgcgtgga cggcAGTACG GAggAaaaaa tcttccgtcg GGCGGAGAtg 151  atcgACAGGg accgtatgtt gcgggACaCg TtggaacGTG TGCGTGCggg 201  gtcgtTctgG TTATGGGTGG TggtggCAtC gATGATGTtt aCCGCCGGAT
```

```
251 TTTCAGgcac ttatCttCTG ATGGACaatC AGGGGCtGAA TtTCTTTTTA
301 GTTTTggcgG GAGTGTtggG CATGaatacG ctgATGCTGG CAGTATGGtt
351 gGCAACGTTG TTCCTGCGCG TGAAAGTGGG ACGGTTTTTC AGCAGTCCGG
401 CGACGTGGTT TCGGGGCAAA GGCCCTGTAA ATCAGGCGGT GTTGCGGCTG
451 TATGCGGACC AGTGGCGGCA ACCTTCGGTA CGATGGAAAA TAGGCGCAAC
501 GGCGCACAGC TTGTGGCTCT GCACGCTGCT CGGAATGCTG GTGTCGGTAT
551 TGCTGCTGCT TTTGGTGCGG CAATATACGT TCAACTGGGA AAGCACGCTG
601 TTGAGCAATG CCGCTTCGGT ACGCGCGGTG GAAATGTTGG CATGGCTGCC
651 GTCGAAACTC GGTTTCCCTG TCCCCGATGC GCGGGCGGTC ATCGAAGGTC
701 GTCTGAACGG CAATATTGCC GATGCGCGGG CTTGGTCGGG GCTGCTGGTC
751 GGCAGTATCG TCTGCTACGG CATCCTGCCG CGCCTCTTGG CTTGGGTAGT
801 GTGTAAAATC CTTTTGAAAA CAAGCGAAAA CGGattgGAT TTGGAAAAAA
851 CCTATTATCA GGCGGTCATC CGCCGCTGGC AGAACAAAAT CACCGATGCG
901 GATACGCGTC GGGAAACCGT GTCCGCCGTT TCGCcgaAAA TCGTCTTGAA
951 CGATGCGCCG AAATGGGCGC TCATGCTGGA GACCGAGTGG CAGGACGGCC
1001 AATGGTTCGA GGGCAGGCTG GCGCAGGAAT GGCTGGATAA GGGCGTTGCC
1051 GCCAATCGGG AACAGGTTGC CGCGCTGGAG ACAGAGCTGA AGCAGAAACC
1101 GGCGCAACTG CTTATCGGCG TACGCGCCCA AACTGTGCCG GACCGGGGCG
1151 TGCTGCGGCA GATTGTGCGG CTTTCGGAAG CGGCGCAGGG CGGCGCGGTG
1201 GTGCAGCTTT TGGCGGAACA GGGGCTTTCA GACGACCTTT CGGAAAAGCT
1251 GGAACATTGG CGTAACGCGC TGACCGAATG CGGCGCGGCG TGGCTTGAGC
1301 CTGACAGGGT GGCGCAGGAA GGCCGTTTGA AAGACCAATA A
```

This encodes a protein having amino acid sequence <SEQ ID 206; ORF33ng-1>:

```
  1 MLNPSRKLVE LVRILNKGGF IFSGDPVQAT EALRRVDGST EEKIFRRAEM

51 IDRDRMLRDT LERVRAGSFW LWVVVASMMF TAGFSGTYLL MDNQGLNFFL

101 VLAGVLGMNT LMLAVWLATL FLRVKVGRFF SSPATWFRGK GPVNQAVLRL

151 YADQWRQPSV RWKIGATAHS LWLCTLLGML VSVLLLLLVR QYTFNWESTL

201 LSNAASVRAV EMLAWLPSKL GFPVPDARAV IEGRLNGNIA DARAWSGLLV

251 GSIVCYGILP RLLAWVVCKI LLKTSENGLD LEKTYYQAVI RRWQNKITDA

301 DTRRETVSAV SPKIVLNDAP KWALMLETEW QDGQWFEGRL AQEWLDKGVA

351 ANREQVAALE TELKQKPAQL LIGVRAQTVP DRGVLRQIVR LSEAAQGGAV

401 VQLLAEQGLS DDLSEKLEHW RNALTECGAA WLEPDRVAQE GRLKDQ*
```

ORF33ng-1 and ORF33-1 show 94.6% identity in 446 aa overlap:

```
                     10         20         30         40         50         60
orf33-1.pep   MLNPSRKLVELVRILDEGGFIFSGDPVQATEALRRVDGSTEEKIIRRAEMIDRNRMLRET
              ||||||||||||||| :||||||||||||||||||||||||||| ||||||||| ||||:
orf33ng-1     MLNPSRKLVELVRILNKGGFIFSGDPVQATEALRRVDGSTEEKIFRRAEMIDRDRMLRDT
                     10         20         30         40         50         60

70         80         90        100        110        120
orf33-1.pep   LERVRAGSFWLWVVAATFAFFTGFSVTYLLMDNQGLNFFLVLAGVLGMNTLMLAVWLAML
              ||||||||||||||: :  :|||||||||||||||||||||||||||||||||||||||
orf33ng-1     LERVRAGSFWLWVVVASMMFTAGFSGTYLLMDNQGLNFFLVLAGVLGMNTLMLAVWLATL
                     70         80         90        100        110        120
```

```
                    130        140        150        160        170        180
orf33-1.pep   FLRVKVGRFFSSPATWFRGKDPVNQAVLRLYADEWRQPSVRWKIGATSHSLWLCTLLGML
              ||||||||||||||||||||||||||||||||:|||||||||||||||:|||||||||||
orf33ng-1     FLRVKVGRFFSSPATWFRGKGPVNQAVLRLYADQWRQPSVRWKIGATAHSLWLCTLLGML
                    130        140        150        160        170        180
                    190        200        210        220        230        240
orf33-1.pep   VSVLLLLLVRQYTFNWESTLLSNAASVRAVEMLAWLPSKLGFPVPDARAVIEGRLNGNIA
              ||||||||||||||||||||||||||||||||||||||||||||||||||||||||||||
orf33ng-1     VSVLLLLLVRQYTFNWESTLLSNAASVRAVEMLAWLPSKLGFPVPDARAVIEGRLNGNIA
                    190        200        210        220        230        240
                    250        260        270        280        290        300
orf33-1.pep   DARAWSGLLVGSIACYGILPRLLAWAVCKILXXTSENGLDLEKPYYQAVIRRWQNKITDA
              |||||||||||||:|||||||||||||:||||||||||||||||:|||||||||||||||
orf33ng-1     DARAWSGLLVGSIVCYGILPRLLAWVVCKILLKTSENGLDLEKTYYQAVIRRWQNKITDA
                    250        260        270        280        290        300
                    310        320        330        340        350        360
orf33-1.pep   DTRRETVSAVSPKIILNDAPKWAVMLETEWQDGEWFEGRLAQEWLDKGVATNREQVAALE
              ||||||||||||||:|||||||||:|||||||||:|||||||||||||||:|||||||||
orf33ng-1     DTRRETVSAVSPKIVLNDAPKWALMLETEWQDGQWFEGRLAQEWLDKGVAANREQVAALE
                    310        320        330        340        350        360
                    370        380        390        400        410        420
orf33-1.pep   TELKQKPAQLLIGVRAQTVPDRGVLRQIVRLSEAAQGGAVVQLLAEQGLSDDLSEKLEHW
              ||||||||||||||||||||||||||||||||||||||||||||||||||||||||||||
orf33ng-1     TELKQKPAQLLIGVRAQTVPDRGVLRQIVRLSEAAQGGAVVQLLAEQGLSDDLSEKLEHW
                    370        380        390        400        410        420
                    430        440
orf33-1.pep   RNALAECGAAWLEPDRAAQEGRLKDQX
              ||||:|||||||||||:||||||||||
orf33ng-1     RNALTECGAAWLEPDRVAQEGRLKDQX
                    430        440
```

Based on the presence of several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 25

The following partial DNA sequence was identified in *N. meningitidis* <SEQ ID 207>:

```
  1  ..CAGAAGAGTT TGTCGAGAAT TCTTTATGG GGTTTGGGCG GCGTGTTTTT
 51    CGGGGTGTCC GGTCTGGTAT GGTTTTCTTT GGGCGTTTCT TT.GAGTGCG
101    CCTGTTTTTC GGGTGTTTCT TTTCGGGGTT CGGGACGGGG GACGTTTGTG
151    GGCAGTACGG GGGTTTCTTT GAGTGTGTTT TCAGCTTGTG TTCC.GGCGT
201    CGTCCGGCTG CCTGTCGGTT TGAGCTGTGT CGGCAGGTTG CG..GTTTGA
251    CCCGGTTTTT CTTGGGTGCG GCAGGGGACG TCATTCTCCT GCCGCTTTCG
301    TCTGTGCCGT CCGGCTGTGC GGGTTCGGAT GAGGCGGCGT GGTGGTGTTC
351    GGGTTGGGCG GCATCTTGTT CCGACTACGC CGTTTGGCAG CCAGAATTCG
401    GTTTCGCGGG GGCTGTCGGT GTGTTGCGGT TCGGCTTGAA GGGTTTTGTC
451    GTCC..
```

This corresponds to the amino acid sequence <SEQ ID 208; ORF34>:

```
  1  ..QKSLSRISLW GLGGVFFGVS GLVWFSLGVS XECACFSGVS FRGSGRGTFV
 51    GSTGVSLSVF SACVXGVVRL PVGLSCVGRL XXLTRFFLGA AGDVILLPLS
101    SVPSGCAGSD EAAWWCSGWA ASCPTTPFGS QNSVSRGLSV CCGSA*RVLS
151    S..
```

Further work revealed the complete nucleotide sequence <SEQ ID 209>:

```
   1 ATGATGATGC CGTTCATAAT GCTTCCTTGG ATTGCkGGTG TGCCTGCCGT
  51 GCCGGGTCAG AATAGGTTGT CCAGAATTTC TTTATGGGGT TTGGGCGGCG
 101 TGTTTTTCGG GGTGTCCGGT TTGGTATGGT TTTCTTTGGG CGTTTCTTTG
 151 GGCTGCGCCT GTTTTTCGGG TGTTTCTTTT CGGGGTTCGG GACGGGGGAC
 201 GTTTGTGGGC AGTACGGGGG TTTCTTTGAG TGTGTTTTCA GCTTGTGTTC
 251 CGGCGTCGTC CGGCTGCCTG TCGGTTTGAG CTGTGTCGGC AGGTTGCGGT
 301 TTGACCCGGT TTTTCTTGGG TGCGGCAGGG GACGGCAGTC CGCTGCCGCT
 351 TTCGTCTGTG CCGTCCGGCT GTGCGGGTTC GGATCAGGCG GCGTGGTGGT
 401 GTTCGGGTTG GGCGGCATCT TGTCCGACTA CGCCGTTTGG CAGCCAGAAT
 451 TCGGTTTCGC GGGGGCTGTC GGTGTGTTGC GGTTCGGCTT GAAGGGTTTT
 501 GTCGCCGTTC GGGTTGAATG TGCTGACGAT GCCTATTGCC AATGCGCCGA
 551 TGGCGGCGAT ACAGATGAGC AATACGGCGC GTATCAGGAG TTTGGGGGTC
 601 AGCCTGAAGG GTTTGTTCGG TTTTTTTGCC ATTTTGATTG TGCTTTTGGG
 651 GTGTCGGGCA ATGCCGTCTG AAGGCGGTTC AGACGGCATT GCCGAGTCAG
 701 CGTTGGACGT AGTTTTGGTA GAGGGTGATG ACTTTTTGTA CGCCGACGGT
 751 GGTGCTGACT TTTTGGGTAA TCTGCGCCTG TTCTTCGGGG GTGAGGATGC
 801 CCATAACGTA GGTTACGTTG CCGTAGGTAA CGATTTTGAC GCGCGCCTGT
 851 GTGGCGGGGC TGATGCCCAA CAGCGTGGCG CGGACTTTGG ATGTGTTCCA
 901 AGTGTCGCCG GCGATGTCGC CGGCAGTGCG CGGCAGGGAG GCGACGGTAA
 951 TATAGTTGTA CACGCCTTCG GCGGCCTGTT CGGAACGTGC AATCTGACCG
1001 ACGAACTGTT TTTCGCCTTC GGTGGCGACT TGTCCGAGCA GCAGCAGGTG
1051 GCGGTTGTAG CCGACGACGG AGATTTGGGG CGTGTAGCCT TTGGTTTGGT
1101 TGTTTTGGCG CAGATAGGAA CGGGCGGTGG TTTCGATACG CAACGCCATA
1151 ACGTTGTCGT CGGTTTGCGC GCCGGTGGTT CGGCGGTCGA CGGCGGATTT
1201 CGCGCCGACG GCGGCGCTTC CGATTACTGC GCTGACGCAG CCGCTAAGGG
1251 CAAGGCTGAA AATGGCGGCA ATCAGGGTGC GGACGGTGTG CGGTTTGGGT
1301 TTCATCGGGT GCTTCCTTTC TTGGGCGTTT CAGACGGCAT TGCTTTGCGC
1351 CATGCCGTCT GA
```

This corresponds to the amino acid sequence <SEQ ID 210; ORF34-1>:

```
   1 MMMPFIMLPW IAGVPAVPGQ NRLSRISLWG LGGVFFGVSG LVWFSLGVSL
  51 GCACFSGVSF RGSGRGTFVG STGVSLSVFS ACVPASSGCL SV*AVSAGCG
 101 LTRFFLGAAG DGSPLPLSSV PSGCAGSDEA AWWCSGWAAS CPTTPFGSQN
 151 SVSRGLSVCC GSA*RVLSPF GLNVLTMPIA NAPMAAIQMS NTARIRSLGV
 201 SLKGLFGFFA ILIVLLGCRA MPSEGGSDGI AESALDVVLV EGDDFLYADG
 251 GADFLGNLRL FFGGEDAHNV GYVAVGNDFD ARLCGGADAQ QRGADFGCVP
 301 SVAGDVAGSA RQGGDGNIVV HAFGGLFGTC NLTDELFFAF GGDLSEQQQV
```

```
351 AVVADDGDLG RVAFGLVVLA QIGTGGGFDT QRHNVVVGLR AGGSAVDGGF

401 RADGGASDYC ADAAAKGKAE NGGNQGADGV RFGFHRVLPF LGVSDGIALR

451 HAV*
```

Computer analysis of this amino acid sequence gave the following results:

Homology with a Predicted ORF from *N. meningitidis* (Strain A)

ORF34 shows 73.3% identity over a 161aa overlap with an ORF (ORF34a) from strain A of *N. meningitidis*:

```
                              10        20        30
orf34.pep               QKSLSRISLWGLGGVFFGVSGLVWFSLGVSXE------CAC
                        ||||||||||||||||||||||||||||||||      |||
orf34a     MMXPXIMLPWIAGVPAVPGQKRLSRXSLWGLGGXFFGVSGLVWFSLGVSXSLGVSXGCAC
                 10        20        30        40        50        60
                   40        50        60        70        80        90
orf34.pep   FSGVSFRGSGRGTFVGSTGVSLSVFSACVXGVVRLPVGLSCVGRLXX-----LTRFFLGA
            |||||||||||||||||||||||||||||:    |::   |::       ||| |||
orf34a      FSGVSFRGSGRGTFVGSTGVSLSVFSACA------PASSGCLSVXAVSAGCGLTRXFXGA
                   70        80        90       100       110
                  100       110       120       130       140       150
orf34.pep   AGDVILLPLSSVPSGCAGSDEAAWWCSGWAASCPTTPFGSQNSVSRGLSVCCCSAXRVLS
            |||   ||||||||||||||| ||||||||||||||||||||||||||||||||| ||||
orf34a      AGDGSPLPLSSVPSGCAGADEEAXXCSGWAASCPTTPFGSQNSVSRGLSVCCCSVWRVLS
                  120       130       140       150       160       170
orf34.pep   S orf34a      PFGXNVLTMPIANAPMAVIQMSNTARIRSLGVSLKGLFXFFAILIVLLGCRAMPSEGGSD
                  180       190       200       210       220       230
```

The complete length ORF34a nucleotide sequence <SEQ ID 211> is:

```
  1 ATGATGATNC CGTTNATAAT GCTTCCTTGG ATTGCGGGTG TGCCTGCCGT

51 GCCGGGTCAG AAGAGGTTGT CGAGAANTTC TTTATGGGGT TTAGGCGGCN

101 TGTTTTTCGG GGTGTCCGGT TTGGTATGGT TTTCTTTGGG CGTTTCTNTT

151 TCTTTGGGTG TTTCTNTGGG CTGTGCCTGT TTTTCGGGTG TTTCTTTTCG

201 GGGTTCGGGA CGGGGGACGT TTGTGGGCAG TACNGGGGTT TCTTTGAGTG

251 TGTTTTCAGC TTGTGCTCCG GCGTCGTCCG GCTGCCTGTC GGTTTNAGCT

301 GTGTCGGCAG GTTGCGGTTT GACCCGGNTT TTCTTNGGTG CGGCAGGGGA

351 CGGCAGTCCG CTGCCGCTTT CGTCTGTGCC GTCCGGCTGT GCGGGTGCGG

401 ATGAGGAGGC GTNGTNGTGT TCGGGTTGGG CGGCATCTTG TCCGACTACG

451 CCGTTTGGCA GCCAGAATTC GGTTTCGCGG GCGCTGTCGG TGTGTTGCGG

501 TTCGGTNTGG AGGGTTTTGT CNCCGTTCGG GTNGAATGTG CTGACGATGC

551 CTATTGCCAA TGCGCCGATG GCGGTGATAC AGATGAGCAA TACGGCGCGT

601 ATCAGGAGTT TGGGGGTCAG CCTGAAGGGT TTGTTCNGTT TTTTTGCCAT

651 TTTGATTGTG CTTTTGGGGT GTCGGGCAAT GCCGTCTGAA GGCGGTTCAG

701 ACGGCATTGC CGAGTCAGCG TTGGACGTAG TTTNGGTAGA GGGTGATGAC

751 TTTTTGTACG CCGACGGTGG TGCTGACTTT TTGGGTAATC TGCGCCTGTT

801 CTTCGGGGGT GAGGATGCCC ATAACGTAGG TTACGTTGCC GTAGGTAACG

851 ATTTTGACGC GCGCCTGTGT GGCGGGGCTG ATGCCCAACA GCGTGGCGCG
```

-continued

```
 901 GACTTTGGAT GTGTTCCAAG TGTCGCCGGC GATGTCGCCG GCAGTGCGCG

951 GCAGGGAGGC GACGGTAATG TANTTGTACA CGCCTTCGGC GGCCTGTTCG

1001 GAACGTGCAA TCTGACCGAC GAACTGTTTC TCGCCTTCGG TGGCGACTTG

1051 TCCGAGCAGC AGCAGGTGGC GGTTGTAGCC GACAACGGAG ATTTGGGGCG

1101 TGTANCCTTT GGTTTGGTTG TTTTGGCGCA GATAGGAGCG GGCGGTGGTT

1151 TCGATACGCA GCGCCATTAC GTTGTCGTCG GTTNGCGCGC CGGTGGTTCG

1201 GCGGTCGACG GCGGATTTCG CGCCGACCGC CGCGCCGCCG ACGACTGCGC

1251 TGACGCAGCC GCCGAGGGCA AGGCTGAGGA CGGCGGCAGT CAGGGTGCGG

1301 ACGGTGTGCG GTTTGGGTTT CATCGGGTGC TTCCTTTCTT GGGCGTTTCA

1351 GACGGCATTG CTTTGCGCCA TGCCGTCTGA
```

This encodes a protein having amino acid sequence <SEQ ID 212>:

```
  1 MMXPXIMLPW IAGVPAVPGQ KRLSRXSLWG LGGXFFGVSG LVWFSLGVSX

51 SLGVSXGCAC FSGVSFRGSG RGTFVGSTGV SLSVFSACAP ASSGCLSVXA

101 VSAGCGLTRX FXGAAGDGSP LPLSSVPSGC AGADEEAXXC SGWAASCPTT

151 PFGSQNSVSR GLSVCCGSVW RVLSPFGXNV LTMPIANAPM AVIQMSNTAR

201 IRSLGVSLKG LFXFFAILIV LLGCRAMPSE GGSDGIAESA LDVVXVEGDD

251 FLYADGGADF LGNLRLFFGG EDAHNVGYVA VGNDFDARLC GGADAQQRGA

301 DFGCVPSVAG DVAGSARQGG DGNVXVHAFG GLFGTCNLTD ELFLAFGGDL

351 SEQQQVAVVA DNGDLGRVXF GLVVLAQIGA GGGFDTQRHY VVVGXRAGGS

401 AVDGGFRADR RAADDCADAA AEGKAEDGGS QGADGVRFGF HRVLPFLGVS

451 DGIALRHAV*
```

ORF34a and ORF34-1 show 91.3% identity in 459 aa overlap:

```
                   10        20        30        40        50        60
orf34a.pep MMXPXIMLPWIAGVPAVPGQKRLSRXSLWGLGGXRFFGVSGLWFSLGVSXSLGVSXGCAC
           || |||||||||||||||||| |||:||||||||| |||||||||||||      ||||
orf34-1    MMMPFIMLPWIAGVPAVPGQNRLSRISLWGLGGVRFFGVSGLWFSLGVSL------GCAC
                   10        20        30        40        50        60

70        80        90       100       110       120
orf34a.pep FSGVSFRGSGRGTFVGSTGVSLSVFSACAPASSGCLSVXAVSAGCGLTRXFXGAAGDGSP
           |||||||||||||||||||||||||||:||||||||||||||||||||| || |||||||
orf34-1    FSGVSFRGSGRGTFVGSTGVSLSVFSACVPASSGCLSVXAVSAGCGLTRFFLGAAGDGSP
                   60        70        80        90       100       110

130       140       150       160       170       180
orf34a.pep LPLSSVPSGCAGADEEAXXCSGWAASCPTTPFGSQNSVSRGLSVCCGSVWRVLSPFGXNV
           |||||||||||| :|| || |||||||||||||||||||||||||||||:| ||||| ||
orf34-1    LPLSSVPSGCAGSDEAAWWCSGWAASCPTTPFGSQNSVSRGLSVCCGSAXRVLSPFGLNV
                  120       130       140       150       160       170

190       200       210       220       230       240
orf34a.pep LTMPIANAPMAVIQMSNTARIRSLGVSLKGLFXFFAILIVLLGCRAMPSEGGSDGIAESA
           ||||||||||| :|||||||||||||||||||| ||||||||||||||||||||||||||
orf34-1    LTMPIANAPMAAIQMSNTARIRSLGVSLKGLFGFFAILIVLLGCRAMPSEGGSDGIAESA
                  180       190       200       210       220       230

250       260       270       280       290       300
orf34a.pep LDVVXVEGDDFLYADGGADFLGNLRLFFGGEDAHNVGYVAVGNDFDARLCGGADAQQRGA
           |||| |||||||||||||||||||||||||||||||||||||||||||||||||||||||
orf34-1    LDVVLVEGDDFLYADGGADFLGNLRLFFGGEDAHNVGYVAVGNDFDARLCGGADAQQRGA
                  240       250       260       270       280       290
```

```
                    310        320        330        340        350        360
orf34a.pep  DFGCVPSVAGDVAGSARQGGDGNVXVHAFGGLFGTCNLTDELFLAFGGDLSEQQQVAVVA
            ||||||||||||||||||||||||:|||||||||||||||||||:||||||||:||||||
orf34-1     DFGCVPSVAGDVAGSARQGGDGNIVVHAFGGLFGTCNLTDELFFAFGGDLSEQQQVAVVA
                    300        310        320        330        340        350

370        380        390        400        410        420
orf34a.pep  DNGDLGRVXFGLVVLAQIGAGGGFDTQRHYVVVGXRAGGSAVDGGFRADRRAADDCADAA
            :|||||||:||||||||||:||||||||||||:|||||||||||||||||||::|||||
orf34-1     DDGDLGRVAFGLVVLAQIGTGGGFDTQRHNVVVGLRAGGSAVDGGFRADGGASDYCADAA
                    360        370        380        390        400        410

430        440        450        460
orf34a.pep  AEGKAEDGGSQGADGVRFGFHRVLPFLGVSDGIALRHAVX
            :||||:||:|||||||||||||||||||||||||||||||
orf34-1     AKGKAENGGNQGADGVRFGFHRVLPFLGVSDGIALRHAVX
                    420        430        440        450
```

15

Homology with a Predicted ORF from *N. gonorrhoeae*
ORF34 shows 77.6% identity over a 161aa overlap with a predicted ORF (ORF34.ng) from *N. gonorrhoeae*:

```
orf34.pep                  QKSLSRISLWGLGGVFFGVSGLVWFSLGVSXE------CAC      35
                           ||||||||||:||||||||||||||||||||        |||
orf34ng    MMMPFIMLPWIAGVPAVPGQKRLSRISLWGLAGVFFGVSGLVWFSLGVSFSLGVSLGCAC  60 orf34.pep  FSGVSFRGSGRGTFVGSTGVSLSVFSACVXGVVRLPVGLSCV-----GRLXXLTRFFLGA  90
           ||||||||||:|||||||||||||||||||   :||:|   :      ||  ||||||||
orf34ng    FSGVSFRGSGWGAFVGSTGVSLSVFSACVP----VPVNESAARAASEGR--GLTRFFLGA 114 orf34.pep  AGDVILLPLSSVPSGCAGSDEAAWWCSGWAASCPTTPFGSQNSVSRGLSVCCGSAXRVLS 150
           |||  ||||||||||||||||||||||||||||||:|||||||||||||||||||:|||
orf34ng    AGDGSPLPLSSVPSGCAGSDEAAWWCSGWAASCPATPFGSQNSVSRGLSVCCGSVWRVLS 174 orf34.pep  S                                                           175 orf34ng    PFGLNVLTMPTANAPMAVIQMSNTARIRSLGVSLKGLFGFFAILIVLLGCRAMPSEGGSD 234
```

The complete length ORF34ng nucleotide sequence <SEQ ID 213> is:

```
  1 ATGATGATGC CGTTCATAAT GCTTCCTTGG ATTGCGGGTG TGCCTGCCGT
 51 GCCGGGTCAA AAGAGGTTGT CGAGAATCTC TTTATGGGGT TTGGCCGGCG
101 TGTTTTTCGG GGTGTCCGGT TTGGTATGGT TTTCTTTGGG CGTTTCTTTT
151 TCTTTGGGTG TTTCTTTGGG CTGCGCCTGT TTTTCGGGTG TTTCTTTTCG
201 GGGTTCGGGA TGGGGGGCGT TTGTGGGCAG TACGGGGGTT TCTTTGAGTG
251 TGTTTTCAGC TTGTGTTCCG GTGCCGGTTA ACGAATCGGC TGCCCGGGCC
301 GCATCCGAAG GGCGCGGTTT gACCCGGTTT TTCTTGGGTG CGGCAGGGGA
351 CGGCAGTCCG CTGCCGCTTT CTTCTGTGCC GTCCGGCTGT GCGGGTTCGG
401 ATGAGGCGGC GTGGTGGTGT TCGGGTTGGG CGGCATCTTG TCCGACGGCG
451 CCGTTTGGCA GCCAGAATTC GGTTTCGCGG GGGCTGTCGG TGTGTTGCGG
501 TTCGGTTTGG AGGGTTTTGT CGCCGTTCGG GTTGAATGTG CTGACGATGC
551 CTACTGCCAA TGCGCCGATG GCGGTGATAC AGATGAGCAA TACGGCGCGT
601 ATCAGGAGTT TGGGGGTCAG CCTGAAGGGT TTGTTCGGTT TTTTTGCCAT
651 TTTGATTGTG CTTTTGGGGT GTCGGGCAAT GCCGTCTGAA GGCGGTTCAG
701 ACGGCATTGC CGAGTCAGCG TTGGACGTAG TTTTGGTAGA GGGTAATGAC
751 TTTTTGTACG CCGAcggTGG TGCTGACTTT TTGGGTAATC TGCGCCTGTT
801 CTTCGGGGGT GAGGATGCCC ATAACGTAGG TTACATTGCC GTAGGTAATG
851 ATTTTGACGC GCGCCTGTGT AGCGGGGCTG ATGCCCAGCA GcgtgGCGCG
```

```
 901 GACTTTGGAC GTGTTCCAAG TGTCGCCGGC GATGTCGCCC GCAGTGCGCG

951 GCAGGGAGGC GACGGTAATG TAGTTGTATA CGCCTTCGGC GGCCTGTTCG

1001 GAACGTGCAA TCTGACCGAC GAACTGTTTT TCGCCTTCGG TGGCGACTTG

1051 TCCGAGCAGC AGCAGGTGGC GGTTGTAGCC GACGACGGAG ATTTGGGGCG

1101 TGTAGCCTTT GGTTTGGTTG TTTTGGCGCA GGTAGGAACG GGCGGTGGTT

1151 TCGATACGCA ACGCCATAAC GTtgtCATCG GTTtgcgcgc CGGTGGTTcg 1201 gCGGTCGATG ACGGATTTTG CGCCGACGGC GGCCCCGCCG ACGACTGCGC

1251 TGAAGCAGCC GCCGAGGGCA AGGCTGAGGA CGGCGGCAAT CAGGGTGCGG

1301 ACGGTGTGTG GTTTGGGTTT CATCGGGGAC TTCCTTTCTT GGGCGTTTCA

1351 GACGGCATTG CTTTGCGCCA TGCCGTCTGA
```

This encodes a protein having amino acid sequence <SEQ ID 214>:

```
  1 MMMPFIMLPW IAGVPAVPGQ KRLSRISLWG LAGVFFGVSG LVWFSLGVSF

51 SLGVSLGCAC FSGVSFRGSG WGAFVGSTGV SLSVFSACVP VPVNESAARA

101 ASEGRGLTRF FLGAAGDGSP LPLSSVPSGC AGSDEAAWWC SGWAASCPTA

151 PFGSQNSVSR GLSVCCGSVW RVLSPFGLNV LTMPTANAPM AVIQMSNTAR

201 IRSLGVSLKG LFGFFAILIV LLGCRAMPSE GGSDGIAESA LDVVLVEGND

251 FLYADGGADF LGNLRLFFGG EDAHNVGYIA VGNDFDARLC SGADAQQRGA

301 DFGRVPSVAG DVARSARQGG DGNVVVYAFG GLFGTCNLTD ELFFAFGGDL

351 SEQQQVAVVA DDGDLGRVAF GLVVLAQVGT GGGFDTQRHN VVIGLRAGGS

401 AVDDGFCADG GPADDCAEAA AEGKAEDGGN QGADGVWFGF HRGLPFLGVS

451 DGIALRHAV*
```

ORF34ng and ORF34-1 show 90.0% identity in 459 aa overlap:

```
                    10         20         30         40         4         50
orf34-1.pep  MMMPFIMLPWIAGVPAVPGQNRLSRISLWGLGGVRFFGVSGLWFSLGVS------LGCAC
             |||||||||||||||||||| ||||||||||:|| |||||||| |||||||      |||||
orf34ng      MMMPFIMLPWIAGVPAVPGQKRLSRISLWGLAGVRFFGVSGLWFSLGVSFSLGVSLGCAC
                     10         20         30         40         50         60

60         70         80         90        100        110
orf34-1.pep  FSGVSFRGSGRGTFVGSTGVSLSVFSACVPASSGCLSVXAVSAGCGLTRFFLGAAGDGSP
             |||||||||| | :||||||||||||||||||:  :  :  |:|  ||||||||||||||
orf34ng      FSGVSFRGSGWGAFVGSTGVSLSVFSACVPVPVNESAARAASEGRGLTRFFLGAAGDGSP
                     70         80         90        100        110        120

120        130        140        150        160        170
orf34-1.pep  LPLSSVPSGCAGSDEAAWWCSGWAASCPTTPFGSQNSVSRGLSVCCGSAXRVLSPFGLNV
             ||||||||||||||||||||||||||||||| ||||||||||||||||||: |||||||||
orf34ng      LPLSSVPSGCAGSDEAAWWCSGWAASCPTAPFGSQNSVSRGLSVCCGSVWRVLSPFGLNV
                    130        140        150        160        170        180

180        190        200        210        220        230
orf34-1.pep  LTMPIANAPMAAIQMSNTARIRSLGVSLKGLFGFFAILIVLLGCRAMPSEGGSDGIAESA
             ||||  |||||| |||||||||||||||||||||||||||||||||||||||||||||||
orf34ng      LTMPTANAPMAVIQMSNTARIRSLGVSLKGLFGFFAILIVLLGCRAMPSEGGSDGIAESA
                    190        200        210        220        230        240

240        250        260        270        280        290
orf34-1.pep  LDVVLVEGDDFLYADGGADFLGNLRLFFGGEDAHNVGYVAVGNDFDARLCGADAQQRGA
             |||||||||:||||||||||||||||||||||||||||:|||||||||||:|||||||||
orf34ng      LDVVLVEGNDFLYADGGADFLGNLRLFFGGEDAHNVGYIAVGNDFDARLCSGADAQQRGA
                    250        260        270        280        290        300
```

```
              300        310        320        330        340        350
orf34-1.pep   DFGCVPSVAGDVAGSARQGGDGNIVVHAFGGLFGTCNLTDELFFAFGGDLSEQQQVAVVA
              ||| ||||||||| |||||||||  ||:||||||||||||||||||||||||||||||
orf34ng       DFGRVPSVAGDVARSARQGGDGNVVVYAFGGLFGTCNLTDELFFAFGGDLSEQQQVAVVA
              310        320        330        340        350        360
              360        370        380        390        400        410
orf34-1.pep   DDGDLGRVAFGLVVLAQIGTGGGFDTQRHNVVVGLRAGGSAVDGGFRADGGASDYCADAA
              ||||||||||||||||||:|||||||||||||:|||||||||||  ||  :|:|: ||
orf34ng       DDGDLGRVAFGLVVLAQVGTGGGFDTQRHNVVIGLRAGGSAVDDGFCADGGPADDCAEAA
              370        380        390        400        410        420
              420        430        440        450
orf34-1.pep   AKGKAENGGNQGADGVRFGFHRVLPFLGVSDGIALRHAVX
              :||||:|||||||||||||||||:|||||||||||||||
orf34ng       AEGKAEDGGNQGADGVWFGFHRGLPFLGVSDGIALRHAVX
              430        440        450        460
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 26

The following partial DNA sequence was identified in *N. meningitidis* <SEQ ID 215>:

```
  1 ATGAAAACCT TCTTCAAAAC CCTTTCCGCC GCCGCACTCG CGCTCATCCT

51 CGCCGCCTGC GGATT.CAAA AAGACAGCGC GCCCGCCGCA TCCGCTTCTG

101 CCGCCGCCGA CAACGGCGCG GCGTAAAAAA GAAATCGTCT TCGGCACGAC

151 CGTCGGCGAC TTCGGCGATA TGGTCAAAGA ACAAATCCAA GCCGAGCTGG

201 AGAAAAAAGG CTACACCGTC AAACTGGTCG AGTTTACCGA CTATGTACGC

251 CCGAATCTGG CATTGGCTGA GGGCGAGTTG
```

This corresponds to the amino acid sequence <SEQ ID 216; ORF4>:

```
  1 MKTFFKTLSA AALALILAAC G.QKDSAPAA SASAAADNGA AKKEIVFGTT

51 VGDFGDMVKE QIQAELEKKG YTVKLVEFTD YVRPNLALAE GEL
```

Further sequence analysis revealed the complete nucleotide sequence <SEQ ID 217>:

```
  1 ATGAAAACCT TCTTCAAAAC CCTTTCCGCC GCCGCACTCG CGCTCATCCT

51 CGCCGCCTGC GGCGGTCAAA AAGACAGCGC GCCCGCCGCA TCCGCTTCTG

101 CCGCCGCCGA CAACGGCGCG GCGAAAAAAG AAATCGTCTT CGGCACGACC

151 GTCGGCGACT TCGGCGATAT GGTCAAAGAA CAAATCCAAG CCGAGCTGGA

201 GAAAAAAGGC TACACCGTCA AACTGGTCGA GTTTACCGAC TATGTACGCC

251 CGAATCTGGC ATTGGCTGAG GGCGAGTTGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GCAAGCTGA

401 AATCGCTGGA AGAAGTCAAA GACGGCAGCA CCGTATCCGC GCCCAACGAC
```

-continued

```
451 CCGTCCAACT TCGCCCGCGT CTTGGTGATG CTCGACGAAC TGGGTTGGAT

501 CAAACTCAAA GACGGCATCA ATCCGTTGAC CGCATCCAAA GCGGACATCG

551 CCGAGAACCT GAAAAACATC AAAATCGTCG AGCTTGAAGC CGCGCAACTG

601 CCGCGTAGCC GCGCCGACGT GGATTTTGCC GTCGTCAACG GCAACTACGC

651 CATAAGCAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This corresponds to the amino acid sequence <SEQ ID 218; ORF4-1>:

```
  1 MKTFFKTLSA AALALILAAC GGQKDSAPAA SASAAADNGA AKKEIVFGTT

51 VGDFGDMVKE QIQAELEKKG YTVKLVEFTD YVRPNLALAE GELDINVFQH

101 KPYLDDFKKE HNLDITEVFQ VPTAPLGLYP GKLKSLEEVK DGSTVSAPND

151 PSNFARVLVM LDELGWIKLK DGINPLTASK ADIAENLKNI KIVELEAAQL

201 PRSRADVDFA VVNGNYAISS GMKLTEALFQ EPSFAYVNWS AVKTADKDSQ

251 WLKDVTEAYN SDAFKAYAHK RFEGYKSPAA WNEGAAK*
```

Computer analysis of this amino acid sequence gave the following results:

Homology with a Predicted ORF from *N. meningitidis* (Strain A)

ORF4 shows 93.5% identity over a 93aa overlap with an ORF (ORF4a) from strain A of *N. meningitidis*:

```
                      10        20        30        40        50        59
orf4.pep      MKTFFKTLSAAALALILAACG-QKDSAPAASASAAADNGAAKKEIVFGTTVGDFGDMVKE
              ||||||||||||||||||||| ||||||||||||||||||| ||||||||||||||||||
orf4a         MKTFFKTLSAAALALILAACGGQKDSAPAASASAAADNGAAXKEIVFGTTVGDFGDMVKE
                      10        20        30        40        50        60
            60        70        80        90
orf4.pep      QIQAELEKKGYTVKLVEFTDYVRPNLALAEGEL
               || ||||||||||||| ||||| |||||||||
orf4a         XIQPELEKKGYTVKLVEXTDYVRXNLALAEGELDINVXQHXXYLDDXKKXHNLDITXVXQ
                      70        80        90       100       110       120
orf4a         VPTAPLGLYPGKLKSLXXVKXGSTVSAPNDPXXFXRVLVMLDELGXIKLKDXIXXXXXXX
                     130       140       150       160       170       180
```

The complete length ORF4a nucleotide sequence <SEQ ID 219> is:

```
  1 ATGAAAACCT TCTTCAAAAC CCTTTCCGCC GCCGCACTCG CGCTCATCCT

51 CGCCGCCTGC GGCGGTCAAA AAGATAGCGC GCCCGCCGCA TCCGCTTCTG

101 CCGCCGCCGA CAACGGCGCG GCGAANAAAG AAATCGTCTT CGGCACGACC

151 GTCGGCGACT TCGGCGATAT GGTCAAAGAA CANATCCAAC CCGAGCTGGA

201 GAAAAAAGGC TACACCGTCA AACTGGTCGA GTNTACCGAC TATGTGCGCN
```

-continued
```
251 CGAATCTGGC ATTGGCTGAG GGCGAGTTGG ACATCAACGT CTTNCAACAC

301 ANACNCTATC TTGACGACTN CAAAAAANAA CACAATCTGG ACATCACCNN

351 AGTCTTNCAA GTGCCGACCG CGCCTTTGGG ACTGTACCCG GGCAAGCTGA

401 AATCGCTGGA NNAAGTCAAA GANGGCAGCA CCGTATCCGC GCCCAACGAC

451 CCGTNNNACT TCGNCCGCGT CTTGGTGATG CTCGACGAAC TGGGTTNGAT

501 CAAACTCAAA GACNGCATCA NNNNGNNGNN NNNANCNANA NNNGANANNN

551 NNNNANNNNT NNNNNNNNNN NNNNNCNNCG NNNNNNNANN NNNNNNNNNN

601 NCGNNTNNNN NNGCNNNNNT NNANNNTNNN NNCNNCNNNN NNNNNTNNNN

651 NANNANNAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This is predicted to encode a protein having amino acid sequence <SEQ ID 220>:

```
  1 MKTFFKTLSA AALALILAAC GGQKDSAPAA SASAAADNGA AXKEIVFGTT

51 VGDFGDMVKE XIQPELEKKG YTVKLVEXTD YVRXNLALAE GELDINVXQH

101 XXYLDDXKKK HNLDITXVXQ VPTAPLGLYP GKLKSLXXVK XGSTVSAPND

151 PXXFXRVLVM LDELGXIKLK DXIXXXXXXX XXXXXXXXXX XXXXXXXXXX

201 XXXXAXXXXX XXXXXXXXXS GMKLTEALFQ EPSFAYVNWS AVKTADKDSQ

251 WLKDVTEAYN SDAFKAYAHK RFEGYKSPAA WNEGAAK*
```

A leader peptide is underlined.

Further analysis of these strain A sequences revealed the complete DNA sequence <SEQ ID 221>:

```
  1 ATGAAAACCT TCTTCAAAAC CCTTTCCGCC GCCGCACTCG CGCTCATCCT

51 CGCCGCCTGC GGCGGTCAAA AAGATAGCGC GCCCGCCGCA TCCGCTTCTG

101 CCGCCGCCGA CAACGGCGCG GCGAAAAAAG AAATCGTCTT CGGCACGACC

151 GTCGGCGACT TCGGCGATAT GGTCAAAGAA CAAATCCAAC CCGAGCTGGA

201 GAAAAAGGC TACACCGTCA AACTGGTCGA GTTTACCGAC TATGTGCGCC

251 CGAATCTGGC ATTGGCTGAG GGCGAGTTGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GGCAAGCTGA

401 AATCGCTGGA AGAAGTCAAA GACGGCAGCA CCGTATCCGC GCCCAACGAC

451 CCGTCCAACT TCGCCCGCGT CTTGGTGATG CTCGACGAAC TGGGTTGGAT

501 CAAACTCAAA GACGGCATCA ATCCGCTGAC CGCATCCAAA GCGGACATTG

551 CCGAAAACCT GAAAAACATC AAAATCGTCG AGCTTGAAGC CGCGCAACTG

601 CCGCGTAGCC GCGCCGACGT GGATTTTGCC GTCGTCAACG GCAACTACGC
```

```
-continued
651 CATAAGCAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This encodes a protein having amino acid sequence <SEQ ID 222; ORF4a-1>:

```
  1 MKTFFKTLSA AALALILAAC GGQKDSAPAA SASAAADNGA AKKEIVFGTT

51 VGDFGDMVKE QIQPELEKKG YTVKLVEFTD YVRPNLALAE GELDINVFQH

101 KPYLDDFKKE HNLDITEVFQ VPTAPLGLYP GKLKSLEEVK DGSTVSAPND

151 PSNFARVLVM LDELGWIKLK DGINPLTASK ADIAENLKNI KIVELEAAQL

201 PRSRADVDFA VVNGNYAISS GMKLTEALFQ EPSFAYVNWS AVKTADKDSQ

251 WLKDVTEAYN SDAFKAYAHK RFEGYKSPAA WNEGAAK*
```

ORF4a-1 and ORF4-1 show 99.7% identity in 287 aa overlap:

```
                 10         20         30         40         50         60
orf4a-1  MKTFFKTLSAAALALILAACGGQKDSAPAASASAAADNGAAKKEIVFGTTVGDFGDMVKE
         ||||||||||||||||||||||||||||||||||||||||||||||||||||||||||||
orf4-1   MKTFFKTLSAAALALILAACGGQKDSAPAASASAAADNGAAKKEIVFGTTVGDFGDMVKE
                 10         20         30         40         50         60

70         80         90        100        110        120
orf4a-1  QIQPELEKKGYTVKLVEFTDYVRPNLALAEGELDINVFQHKPYLDDFKKEHNLDITEVFQ
         ||| ||||||||||||||||||||||||||||||||||||||||||||||||||||||||
orf4-1   QIQAELEKKGYTVKLVEFTDYVRPNLALAEGELDINVFQHKPYLDDFKKEHNLDITEVFQ
                 70         80         90        100        110        120

130        140        150        160        170        180
orf4a-1  VPTAPLGLYPGKLKSLEEVKDGSTVSAPNDPSNFARVLVMLDELGWIKLKDGINPLTASK
         ||||||||||||||||||||||||||||||||||||||||||||||||||||||||||||
orf4-1   VPTAPLGLYPGKLKSLEEVKDGSTVSAPNDPSNFARVLVMLDELGWIKLKDGINPLTASK
                130        140        150        160        170        180

190        200        210        220        230        240
orf4a-1  ADIAENLKNIKIVELEAAQLPRSRADVDFAVVNGNYAISSGMKLTEALFQEPSFAYVNWS
         ||||||||||||||||||||||||||||||||||||||||||||||||||||||||||||
orf4-1   ADIAENLKNIKIVELEAAQLPRSRADVDFAVVNGNYAISSGMKLTEALFQEPSFAYVNWS
                190        200        210        220        230        240

250        260        270        280
orf4a-1  AVKTADKDSQWLKDVTEAYNSDAFKAYAHKRFEGYKSPAAWNEGAAKX
         ||||||||||||||||||||||||||||||||||||||||||||||||
orf4-1   AVKTADKDSQWLKDVTEAYNSDAFKAYAHKRFEGYKSPAAWNEGAAKX
                250        260        270        280
```

Homology with an Outer Membrane Protein of *Pasteurella haemolitica* (Accession q08869).

ORF4 and this outer membrane protein show 33% aa identity in 91aa overlap:

```
                                         10        20
lip2.pasha                       MNFKKLLGVALVSALALTACKDEKAQAP----
                                 || |  ::||  || :|   :|:   |
ORF4       VXTPNPDGRTPCPSFLFETATTSGENMKTFFKTLSAAAL--ALILAACGFKKTARPPHPL
                110       120       130       140         150
              30        40        50        60        70        80
lip2.pasha  -ATTAKTENKAPLKVGVMTGPEAQMTEVAVKIAKEKYGLDVELVQFTEYTQPNAALHSKD
            : ::     |: :    |::  ::    || |   |:|::|::||  ||      :
ORF4        LPPPTTARRKKEIVFGTTVGDFGDMVKEQIQAELEKKGYTVKLVEFTDYVRPNLALAEGE
              160       170       180       190       200       210
              90       100       110       120       130       140
lip2.pasha  LDANAFQTVPYLEQEVKDRGYKLAIIGNTLVWPIAAYSKKIKNISELKDGATVAIPNNAS
            |
ORF4        L.....
```

Homology with a Predicted ORF from *N. gonorrhoeae*

ORF4 shows 93.6% identity over a 94aa overlap with a predicted ORF (ORF4.ng) from *N. gonorrhoeae*:

```
                                            10        20        30
orf4nm.pep                         MKTFFKTLSAAALALILAACGXQKDSAPAA
                                   ||||||||:|:|||||||||| ||||||||
orf4ng     RANAVXTPNPDGRTPCLSFLFETATTSGENMKTFFKTLSTASLALILAACGGQKDSAPAA
              200       210       220       230       240       250
              40        50        60        70        80        89
orf4nm.pep SASA-AADNGAAKKEIVFGTTVGDFGDMVKEQIQAELEKKGYTVKLVEFTDYVRPNLALA
           ||:| :||||||||||||||||||||||||||||||||||||||||||||||||||||||
orf4ng     SAAAPSADNGAAKKEIVFGTTVGDFGDMVKEQIQAELEKKGYTVKLVEFTDYVRPNLALA
              260       270       280       290       300       310
             90
orf4nm.pep EGEL
           ||||
orf4ng     EGELDINVFQHKPYLDDFKKEHNLDITEAFQVPTAPLGLYPGKLKSLEEVKDGSTVSAPN
              320       330       340       350       360       370
```

The complete length ORF4ng nucleotide sequence <SEQ ID 223> was predicted to encode a protein having amino acid sequence <SEQ ID 224>:

```
  1 MKTFFKTLST ASLALILAAC GGQKDSAPAA SAAAPSADNG AAKKEIVFGT

51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

Further analysis revealed the complete length ORF4ng DNA sequence <SEQ ID 225> to be:

```
  1 atgAAAACCT TCTTCAAAAC cctttccgcc gccgcaCTCG CGCTCATCCT

51 CGCAGCCTGc ggCggtcaAA AAGACAGCGC GCCCgcagcc tctgcCGCCG

101 CCCCTTCTGC CGATAACGgc gCgGCGAAAA AAGAAAtcgt ctTCGGCACG

151 AccgtgggCg acttcggcgA TAtggTCAAA GAACAAATCC AagcCGAgct 201 gGAGAAAAAA GgctACACCg tcAAattggt cgaatttacc gactatgtGC 251 gCCCGAATCT GGCATTGGCG GAGGGCGAGT TGGACATCAA CGTCTTCCAA

301 CACAAACCCT ATCTTGACGA TTTCAAAAAA GAACACAACC TGGACATCAC
```

```
                    -continued
351 CGAAGCCTTC CAAGTGCCGA CCGCGCCTTT GGGACTGTAT CCGGGCAAAC 401 TGAAATCGCT GGAAGAAGTC AAAGACGGCA GCACCGTATC CGCGCCCAac 451 gACccgTCCA ACTTCGCACG CGCCTTGGTG ATGCTGAACG AACTGGGTTG

501 GATCAAACTC AAAGACGGCA TCAATCCGCT GACCGCATCC AAAGCCGACA

551 TCGCGGAAAA CCTGAAAAAC ATCAAAATCG TCGAGCTTGA AGCCGCACAA

601 CTGCCGCGCA GCCGCGCCGA CGTGGATTTT GCCGTCGTCA ACGGCAACTA

651 CGCCATAAGC AGCGGCATGA AGCTGACCGA AGCCCTGTTC CAAGAGCCGA

701 GCTTTGCCTA TGTCAACTGG TCTGCCgtcA AAACCGCCGA CAAAGACAGC

751 CAATGGCTTA AAGACGTAAC CGAGGCCTAT AACTCCGACG CGTTCAAAGC

801 CTACGCGCAC AAACGCTTCG AGGGCTACAA ATACCCTGCC GCATGGAATG

851 AAGGCGCAGC CAAATAA
```

This encodes a protein having amino acid sequence <SEQ ID 226; ORF4ng-1>:

```
  1 MKTFFKTLSA AALALILAAC GGQKDSAPAA SAAAPSADNG AAKKEIVFGT

51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

This shows 97.6% identity in 288 aa overlap with ORF4-1:

```
                    10         20         30         40         50         59
orf4-1.pep  MKTFFKTLSAAALALILAACGGQKDSAPAASASA-AADNGAAKKEIVFGTTVGDFGDMVK
            |||||||||||||||||||||||||||||||||: :||||||||||||||||||||||||
orf4ng-1    MKTFFKTLSAAALALILAACGGQKDSAPAASAAAPSADNGAAKKEIVFGTTVGDFGDMVK
                    10         20         30         40         50         60

60         70         80         90        100        110        119
orf4-1.pep  EQIQAELEKKGYTVKLVEFTDYVRPNLALAEGELDINVFQHKPYLDDFKKEHNLDITEVF
            ||||||||||||||||||||||||||||||||||||||||||||||||||||||||||:|
orf4ng-1    EQIQAELEKKGYTVKLVEFTDYVRPNLALAEGELDINVFQHKPYLDDFKKEHNLDITEAF
                    70         80         90        100        110        120

120        130        140        150        160        170        179
orf4-1.pep  QVPTAPLGLYPGKLKLLEEVKDGSTVSAPNDPSNFARVLVMLDELGWIKLKDGINPLTAS
            |||||||||||||||||||||||||||||||||||||:|||:||||||||||||||||||
orf4ng-1    QVPTAPLGLYPGKLKLLEEVKDGSTVSAPNDPSNFARALVMLNELGWIKLKDGINPLTAS
                   130        140        150        160        170        180

180        190        200        210        220        230        239
orf4-1.pep  KADIAENLKNIKIVELEAAQLPRSRADVDFAVVNGNYAISSGMKLTEALFQEPSFAYVNW
            ||||||||||||||||||||||||||||||||||||||||||||||||||||||||||||
orf4ng-1    KADIAENLKNIKIVELEAAQLPRSRADVDFAVVNGNYAISSGMKLTEALFQEPSFAYVNW
                   190        200        210        220        230        240

240        250        260        270        280
orf4-1.pep  SAVKTADKDSQWLKDVTEAYNSDAFKAYAHKRFEGYKSPAAWNEGAAKX
            |||||||||||||||||||||||||||||||||||||||:||||||||
orf4ng-1    SAVKTADKDSQWLKDVTEAYNSDAFKAYAHKRFEGYKYPAAWNEGAAKX
                   250        260        270        280
```

In addition, ORF4ng-1 shows significant homology with an outer membrane protein from the database:

```
ID LIP2_PASHA  STANDARD;   PRT;   276 AA.
AC Q08869;
DT 01-NOV-1995 (REL. 32, CREATED)
DT 01-NOV-1995 (REL. 32, LAST SEQUENCE UPDATE)
DT 01-NOV-1995 (REL. 32, LAST ANNOTATION UPDATE)
DE 28.2 KD OUTER MEMBRANE PROTEIN PRECURSOR....
SCORES Initl: 279 Initn: 416 Opt: 494
Smith-Waterman score: 494; 36.0% identity in 275 aa overlap
                     10        20         30        40        50
orf4ng-1.pep    MKTFFKTLSAAAL--ALILAACGGQKDSAPAASAAAPSADNGAAKKEIVFGTTVGDFGDM
                |||    ::||   || |:||       ::|    :::      :|    |: |  :|
lip2_pasha      MNFKKLLGVALVSALALTACKDEKAQAPATTA---KTENKAPLK---VGVMTGPEAQM
                        10        20         30        40          50
                  60        70        80        90       100       110
orf4ng-1.pep    VKEQIQAELEKKGYTVKLVEFTDYVRPNLALAEGELDINVFQHKPYLDDFKKEHNLDITE
                ::  ::     |||   :||:|:|::||  ||    :|| :|| |||::   |::   ::
lip2_pasha      TEVAVKIAKEKYGLDVELVQFTEYTQPNAALHSKDLDANAFQTVPYLEQEVKDRGYKLAI
                     60        70        80        90       100       110
                    120       130       140       150       160       170
orf4ng-1.pep    AFQVPTAPLGLYPGKLKSLEEVKDGSTVSAPNDPSNFARALVMLNELGWIKLKDGINPLT
                :: ::   |::  |: :: :|||:||:  ||:  :|  ||::  |:||::|| || :
lip2_pasha      IGNTLVWPIAAYSKKIKNISELKDGATVAIPNNASNTARALLLLQAHGLLKLKDPKN-VF
                    120       130       140       150       160       170
                   180       190       200       210       220       230
orf4ng-1.pep    ASKADIAENLKNIKIVELEAAQLPRSRADVDFAVVNGNYAISSGMKLTE--ALFQEPSFA
                |::  ||  ||  ||||||:  :::    |   ||::||:|::  ::|:    :   :
lip2_pasha      ATENDIIENPKNIKIVQADTSLLTRMLDDVELAVINNTYAGQAGLSPDKDGIIVESKDSP
                    180       190       200       210       220       230
                  240       250       260       270       280      289
orf4ng-1.pep    YVNWSAVKTADKDSQWLKDVTEAYNSDAFKAYAHKRPEGYKYPAAWNEGAAKX
                |||   : :  :||:    |:  ::::::   |||  |:|
lip2_pasha      YVNLVVSREDNKDDPRLQTFVKSFQTEEVFQEALKLFNGGVVKGW
                    240       250       260       270
```

Based on this analysis, including the homology with the outer membrane protein of *Pasteurella haemolitica*, and on the presence of a putative prokaryotic membrane lipoprotein lipid attachment site in the gonococcal protein, it was predicted that these proteins from *N. meningitidis* and *N. gonorrhoeae*, and their epitopes, could be useful antigens for vaccines or diagnostics, or for raising antibodies.

Figure 8E:
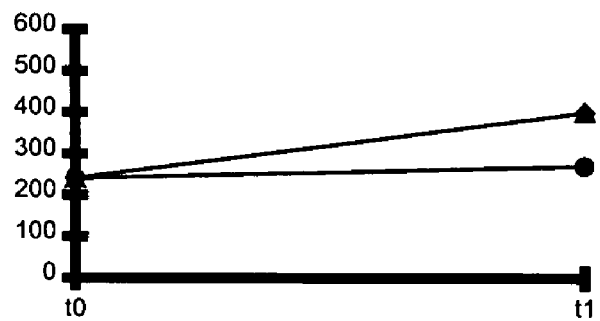

ORF4-1 (30 kDa) was cloned in pET and pGex vectors and expressed in *E. coli*, as described above. The products of protein expression and purification were analyzed by SDS-PAGE. FIGS. 8A and 8B show, respectively, the results of affinity purification of the His-fusion and GST-fusion proteins. Purified His-fusion protein was used to immunise mice, whose sera were used for ELISA (positive result), Western blot (FIG. 8C), FACS analysis (FIG. 8D), and a bactericidal assay (FIG. 8E). These experiments confirm that ORF4-1 is a surface-exposed protein, and that it is a useful immunogen.

Figure 8F:
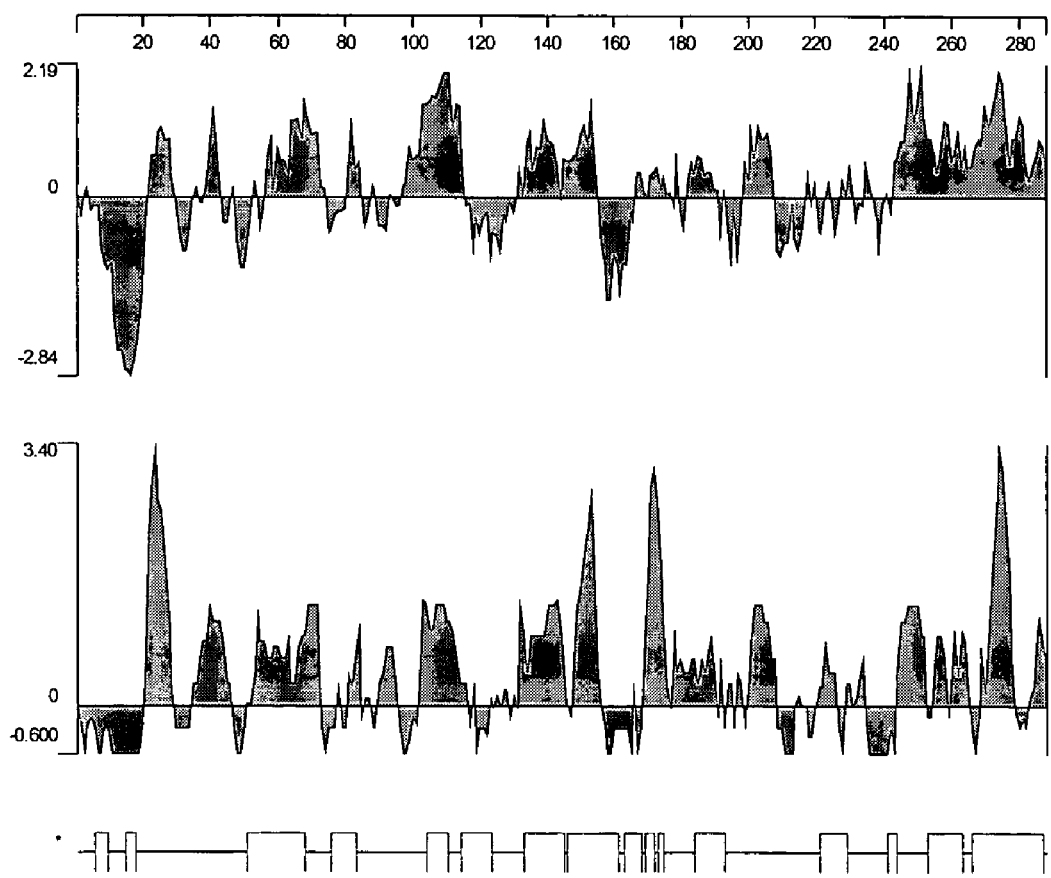

FIG. 8F shows plots of hydrophilicity, antigenic index, and AMPHI regions for ORF4-1.

Example 27

The following partial DNA sequence was identified in *N. meningitidis* <SEQ ID 227>:

```
  1 CCTCGTCGTC CTCGGCATGC TCCAGTTTCA AGGGGCGATT TACTCCAAGG

51 CGGTGGAACG TATGCTCGGC ACGGTCATCG GGCTGGGCGC GGGTTTGGGC

101 GTTTTATGGC TGAACCAGCA TTATTTCCAC GGCAACCTCC TCTTCTACCT

151 CACCGTCGGC ACGGCAAGCG CACTGGCCGG CTGGGCGGCG GTCGGCAAAA

201 ACGGCTACGT CCCTmTGCTG GCAGGGCTGA CGATGTGTAT GCTCATCGGC

251 GACAACGGCA GCGAATGGCT CGACAGCGGA CTCATGCGCG CCATGAACGT

301 CCTCATCGGC GyGGCCATCG CCATCGCCGC CGCCAAACTG CTGCCGCTGA

351 AATCCACACT GATGTGGCGT TTCATGCTTG CCGACAACCT GGCCGACTGC

401 AGCAAAATGA TTGCCGAAAT CAGCAACGGC AGGCGCATGA CCCGCGAACG

451 CCTCGAGGAG AACATGGCGA AAATGCGCCA AATCAACGCA CGCATGGTCA

501 AAAGCCGCAG CCATCTCGCC GCCACATCGG GCGAAAGCTG CATCAGCCCC

551 GCCATGATGG AAGCCATGCA GCACGCCCAC CGTAAAATCG TCAACACCAC

601 CGAGCTGCTC CTGACCACCG CCGCCAAGCT GCAATCTCCC AAACTCAACG

651 GCAGCGAAAT CCGGCTGCTT GACCGCCACT TCACACTGCT CCAAAC....
```

-continued
```
701 ........................ GC AGACACGCCC GCCGCATCCG

751 CATCGACACC GCCATCAACC CCGAACTGGA AGCCCTCGCC GAACACCTCC

801 ACTACCAATG GCAGGGCTTC CTCTGGCTCA GCACCGATAT GCGTCAGGAA

851 ATTTCCGCCC TCGTCATCCT GCTGCAACGC ACCCGCCGCA AATGGCTGGA

901 TGCCCACGAA CGCCAACACC TGCGCCAAAG CCTGCTTGA
```

This corresponds to the amino acid sequence <SEQ ID 228; ORF8>:

```
  1 ......PRRP RHAPVSRGDL LQGGGTYARH GHRAGRGFGR FMAEPALFPR

51 QPPLLPHRRH GKRTGRLGGG RQKRLRPXAG RADDVYAHRR QRQRMARQRT

101 HARHERPHRR GHRHRRRQTA AAEIHTDVAF HACRQPGRLQ QNDCRNQQRQ

151 AHDPRTPRGE HGENAPNQRT HGQKPQPSRR HIGRKLHQPR HDGSHAARPP

201 XNRQHHRAAP DHRRQAAISQ TQRQRNPAAX PPLHTAPN.. .........Q

251 TRPPHPHRHR HQPRTGSPRR TPPLPMAGLP LAQHRYASGN FRPRHPAATH

301 PPQMAGCPRT PTPAPKPA*
```

Computer analysis of this amino acid sequence gave the following results:

Sequence Motifs

ORF8 is proline-rich and has a distribution of proline residues consistent with a surface localization. Furthermore the presence of an RGD motif may indicate a possible role in bacterial adhesion events.

Homology with a Predicted ORF from *N. gonorrhoeae*

ORF8 shows 86.5% identity over a 312aa overlap with a predicted ORF (ORF8.ng) from *N. gonorrhoeae*:

```
orf8ng     1 MDRDDRLRRPRHAPVPRRDLLQRGGTYARYGHRAGRGFGRFMAEPALFPR  50
             |||||||| | |||| |||||| :||||||||||||||||||||||||||
orf8.pep   1 ......PRRPRHAPVSRGDLLQGGGTYARHGHRAGRGFGRFMAEPALFPR  44 orf8ng    51 QPPLLPDHRHGKRTGRLGGGRQKRLRPYVGGADDVHAHRRQRQRMARQRP 100
             ||||||  |||||||||||||||||||| ||:|| |||||||||||||||
orf8.pep  45 QPPLLPHRRHGKRTGRLGGGRQKRLRPXAGRADDVYAHRRQRQRMARQRP  94 orf8ng   101 DARDERPHRRRHRHCRRQTAAAEIHTDVAFHACRQPGRLQQNDCRNQQRQ 150
             || |||||||  |||| ||||||||||||||||||||| ||||||||||
orf8.pep  95 HARHERPHRRGHRHRRRQTAAAEIHTDVAFHACRQPGRMQQNDCRNQQRQ 144 orf8ng   151 AYDARTFGAEYGQNAPNQRTHGQKPQPPRRHIGRKPHQPLHDGSHAARPP 200
             |:|||   |:|:||||||||||||||| |||||| ||| |||||||||||
orf8.pep 145 AHDPRTPRGEHGENAPNQRTHGQKPQSPRRHIGRKLHQPRHDGSHAARPP 194 orf8ng   201 QNRQHHRAAPDHRRQAAISQTQRQRNPAARPPLHTAPNRPATNRRPHQRQ 250
             ||||||||||||||||||||||||||||||  |||||||          |
orf8.pep 195 QNRQHHRAAPDHRRQAAISQTQRQRNPAAXPPLHTAPN...........Q 244 orf8ng   251 TRPPHPHRHRHQPRTGSPRRTPPLPMAGFPLAQHQYASGNFRPRHPPATH 300
             |||||||||||||||||||||||||||| ||||| ||||||||||| |||
orf8.pep 245 TRPPHPHRHRHQPRTGSPRRTPPLPMAGLPLAQHRYASGNFRPRHPAATH 294 orf8ng   301 PPQMAGCPRTPTPAPKPA* 319
             |||||||||||||||||||
orf8.pep 295 PPQMAGCPRTPTPAPKPA* 313
```

The complete length ORF8ng nucleotide sequence <SEQ ID 229> is predicted to encode a protein having amino acid sequence <SEQ ID 230>:

```
  1 MDRDDRLRRP RHAPVPRRDL LQRGGTYARY GHRAGRGFGR FMAEPALFPR
 51 QPPLLPDHRH GKRTGRLGGG RQKRLRPYVG GADDVHAHRR QRQRMARQRP
101 DARDERPHRR RHRHCRRQTA AAEIHTDVAF HACRQPGRLQ QNDCRNQQRQ
151 AYDARTFGAE YGQNAPNQRT HGQKPQPPRR HIGRKPHQPL HDGSHAARPP
201 QNRQHHRAAP DHRRQAAISQ TQRQRNPAAR PPLHTAPNRP ATNRRPHQRQ
251 TRPPHPHRHR HQPRTGSPRR TPPLPMAGFP LAQHQYASGN FRPRHPPATH
301 PPQMAGCPRT PTPAPKPA*
```

Based on the sequence motifs in these proteins, it is predicted that the proteins from N. meningitidis and N. gonorrhoeae, and their epitopes, could be useful antigens for vaccines or diagnostics, or for raising antibodies.

Example 28

The following partial DNA sequence was identified in N. meningitidis <SEQ ID 231>:

```
  1 ..GAAATCAGCC TGCGGTCCGA CNACAGGCCG GTTTCCGTGN CGAAGCGGCG
 51   GGATTCGGAA CGTTTTCTGC TGTTGGACGG CGGCAACAGC CGGCTCAAGT
101   GGGCGTGGGT GGAAAACGGC ACGTTCGCAA CCGTCGGTAG CGCGCCGTAC
151   CGCGATTTGT CGCCTTTGGG CGCGGAGTGG GCGGAAAAGG CGGATGGAAA
201   TGTCCGCATC GTCGGTTGCG CTGTGTGCGG AGAATTCAAA AAGGCACAAG
251   TGCAGGAACA GCTCGCCCGA AAAATCGAGT GGCTGCCGTC TTCCGCACAG
301   GCTTT.GGCA TACGCAACCA CTACCGCCAC CCCGAAGAAC ACGGTTCCGA
351   CCGCTGGTTC AACGCCTTGG GCAGCCGCCG CTTCAGCCGC AACGCCTGCG
401   TCGTCGTCAG TTGCGGCACG GCGGTAACGG TTGACGCGCT CACCGATGAC
451   GGACATTATC TCGGAGA.GG AACCATCATG CCCGGTTTCC ACCTGATGAA
501   AGAATCGCTC GCCGTCCGAA CCGCCAACCT CAACCGGCAC GCCGGTAAGC
551   GTTATCCTTT CCCGACCGG..
```

This corresponds to the amino acid sequence <SEQ ID 232; ORF61>:

```
  1 ..EISLRSDXRP VSVXKRRDSE RFLLLDGGNS RLKWAWVENG TFATVGSAPY
 51   RDLSPLGAEW AEKADGNVRI VGCAVCGEFK KAQVQEQLAR KIEWLPSSAQ
101   AXGIRNHYRH PEEHGSDRWF NALGSRRFSR NACVVVSCGT AVTVDALTDD
151   GHYLGXGTIM PGFHLMKESL AVRTANLNRH AGKRYPFPT..
```

Further work revealed the complete nucleotide sequence <SEQ ID 233>:

```
   1 ATGACGGTTT TGAAGCTTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGCG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence <SEQ ID 234; ORF61-1>:

```
  1 MTVLKLSHWR VLAELADGLP QHVSQLARMA DMKPQQLNGF WQQMPAHIRG

51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY

151 ELGSLSPVAA VACRRALSRL GLDVQIKWPN DLVVGRDKLG GILIETVRTG

201 GKTVAVVGIG INFVLPKEVE NAASVQSLFQ TASRRGNADA AVLLETLLVE

251 LDAVLLQYAR DGFAPFVAEY QAANRDHGKA VLLLRDGETV FEGTVKGVDG

301 QGVLHLETAE GKQTVVSGEI SLRSDDRPVS VPKRRDSERF LLLDGGNSRL

351 KWAWVENGTF ATVGSAPYRD LSPLGAEWAE KADGNVRIVG CAVCGEFKKA

401 QVQEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRHAGK

501 RYPFPTTTGN AVASGMMDAV CGSVMMMHGR LKEKTGAGKP VDVIITGGGA

551 AKVAEALPPA FLAENTVRVA DNLVIYGLLN MIAAEGREYE HI*
```

Figure 9:
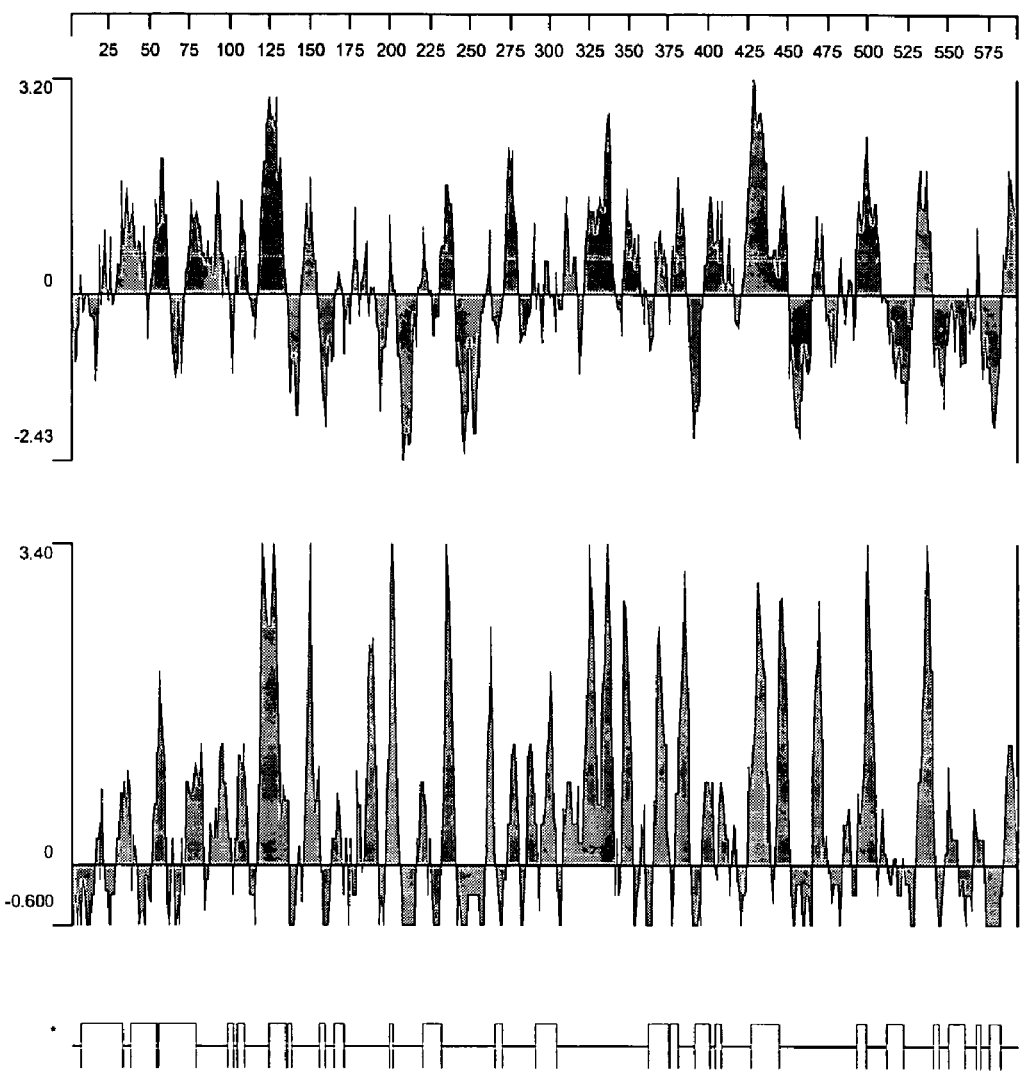

FIG. 9 shows plots of hydrophilicity, antigenic index, and AMPHI regions for ORF61-1. Further computer analysis of this amino acid sequence gave the following results:

Homology with the baf Protein of *B. pertussis* (Accession Number U12020).

ORF61 and baf protein show 33% aa identity in 166aa overlap:

```
orf61   23 LLLDGGNSRLKWAWVE-NGTFATVGSAPYR----DLSPLGAEWAEKADGNVRIVGCAVCG   77
           +L+D GNSRLK  W + +   A    AP       DL  LG A       R +G  V G
baf      3 ILIDSGNSRLKVGWFDPDAPQAAREPAPVAFDNLDLDALGRWLATLPRRPQRALGVNVAG   62 orf61   78 EFKKAQVQEQLAR---KIEWLPSSAQAXGIRNHYRHPEEHGSDRW---FNALGSRRFSRN  131
              +   +   L       I WL +    A G+RN YR+P++ G+DRW       L   +
baf     63 LARGEAIAATLRAGGCDIRWLRAQPLAMGLRNGYRNPDQLGADRWACMVGVLARQPSVHP  122 orf61  132 ACVVVSCGTAVTVDALTDDGHYLGXGTIMPGFHLMKESLAVRTANL              177
              +V S GTA T+D +   D  + G G I+PG  +M+  +LA   TA+L
baf    123 PLLVASFGTATTLDTIGPDNVFPG-GLILPGPAMMRGALAYGTAHL              167
```

Homology with a Predicted ORF from *N. meningitidis* (Strain A)

ORF61 shows 97.4% identity over a 189aa overlap with an ORF (ORF61a) from strain A of *N. meningitidis*:

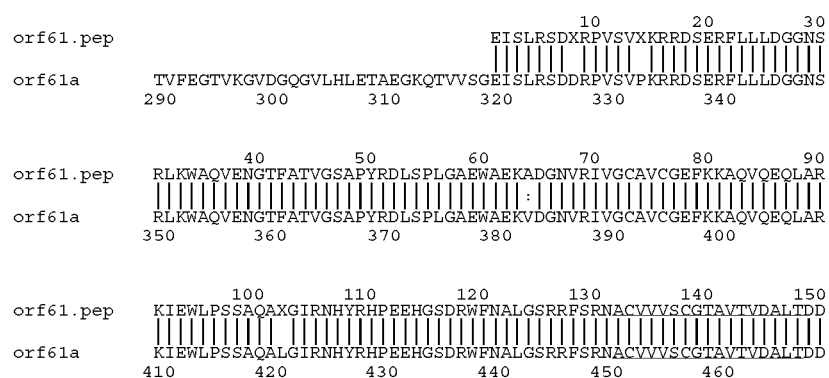

```
                    160         170         180      189
orf61.pep   GHYLGXGTIMPGFHLMKESLAVRTANLNRHAGKRYPFPT
            ||||| ||||||||||||||||||||||||||||||||
orf61a      GHYLG-GTIMPGFHLMKESLAVRTANLNRHAGKRYPFPTTTGNAVASGMMDAVCGSVMMM
            470         480         490         500         510         520
orf61a      HGRLKEKTGAGKPVDVIITGGGAAKVAEALPPAFLAENTVRVADNLVIHGLLNLIAAEGG
            530         540         550         560         570         580
```

The complete length ORF61a nucleotide sequence <SEQ ID 235> is:

```
   1 ATGACGGTTT TGAAGCCTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGTG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGCC GGCGCGCCTT
 501 GTCGCGTTTG GGTTTGAAAA CGCAAATCAA GTGGCCAAAC GATTTGGTCG
 551 TCGGACGCGA CAAATTGGGC GGCATTCTGA TTGAAACGGT CAGGACGGGC
 601 GGCAAAACGG TTGCCGTGGT CGGTATCGGC ATCAATTTCG TGCTGCCCAA
 651 GGAAGTGGAA AACGCCGCTT CCGTGCAATC GCTGTTTCAG ACGGCATCGC
 701 GGCGGGGAAA TGCCGATGCC GCCGTGTTGC TGGAAACGCT GTTGGCGGAA
 751 CTTGATGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTC TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGACGTTTC GCAACCGTCG GTAGCGCGCC
1101 GTACCGCGAT TTGTCGCCTT TGGGCGCGGA GTGGGCGGAA AAGGTGGATG
1151 GAAATGTCCG CATCGTCGGT TGCGCCGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
```

```
1601 AAACCGGGGC GGGCAAGCCT GTCGATGTCA TCATTACCGG CGGCGGCGCG

1651 GCAAAAGTTG CCGAAGCCCT GCCGCCTGCA TTTTTGGCGG AAAATACCGT

1701 GCGCGTGGCG GACAACCTCG TCATTCACGG GCTGCTGAAC CTGATTGCCG

1751 CCGAAGGCGG GGAATCGGAA CATACTTAA
```

This encodes a protein having amino acid sequence <SEQ ID 236>:

```
  1 MTVLKPSHWR VLAELADGLP QHVSQLARMA DMKPQQLNGF WQQMPAHIRG

51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY

151 ELGSLSPVAA VACRRALSRL GLKTQIKWPN DLVVGRDKLG GILIETVRTG

201 GKTVAVVGIG INFVLPKEVE NAASVQSLFQ TASRRGNADA AVLLETLLAE

251 LDAVLLQYAR DCFAPFVAEY QAANRDHGKA VLLLRDGETV FEGTVKGVDG

301 QGVLHLETAE GKQTVVSGEI SLRSDDRPVS VPKRRDSERF LLLDGGNSRL

351 KWAWVENGTF ATVGSAPYRD LSPLGAEWAE KVDGNVRIVG CAVCGEFKKA

401 QVQEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRHAGK

501 RYPFPTTTGN AVASGMMDAV CGSVMMMHGR LKEKTGAGKP VDVIITGGGA

551 AKVAEALPPA FLAENTVRVA DNLVIHGLLN LIAAEGGESE HT*
```

ORF61a and ORF61-1 show 98.5% identity in 591 aa overlap:

```
                    10        20        30        40        50        60
    orf61a.pep    MTVLKPSHWRVLAELADGLPQHVSQLARMADMKPQQLNGFWQQMPAHIRGLLRQHDGYWR
                  ||||||:|||||||||||||||||||||||||||||||||||||||||||||||||||||
    orf61-1       MTVLKLSHWRVLAELADGLPQHVSQLARMADMKPQQLNGFWQQMPAHIRGLLRQHDGYWR
                    10        20        30        40        50        60
                    70        80        90       100       110       120
    orf61a.pep    LVRPLAVFDAEGLRELGERSGFQTALKHECASSNDEILELARIAPDKAHKTICVTHLQSK
                  ||||||||||||||||||||||||||||||||||||||||||||||||||||||||||||
    orf61-1       LVRPLAVFDAEGLRELGERSGFQTALKHECASSNDEILELARIAPDKAHKTICVTHLQSK
                    70        80        90       100       110       120
                   130       140       150       160       170       180
    orf61a.pep    GRGRQGRKWSHRLGECLMFSFGWVFDRPQYELGSLSPVAAVACRRALSRLGLKTQIKWPN
                  |||||||||||||||||||||||||||||||||||||||||||||||||||| :||||||
    orf61-1       GRGRQGRKWSHRLGECLMFSFGWVFDRPQYELGSLSPVAAVACRRALSRLGLDVQIKWPN
                   130       140       150       160       170       180
                   190       200       210       220       230       240
    orf61a.pep    DLVVGRDKLGGILIETVRTGGKTVAVVGIGINFVLPKEVENAASVQSLFQTASRRGNADA
                  ||||||||||||||||||||||||||||||||||||||||||||||||||||||||||||
    orf61-1       DLVVGRDKLGGILIETVRTGGKTVAVVGIGINFVLPKEVENAASVQSLFQTASRRGNADA
                   190       200       210       220       230       240
                   250       260       270       280       290       300
    orf61a.pep    AVLLETLLAELDAVLLQYARDGFAPFVAEYQAANRDHGKAVLLLRDGETVFEGTVKGVDG
                  ||||||||:|||||||||||||||||||||||||||||||||||||||||||||||||||
    orf61-1       AVLLETLLVELDAVLLQYARDGFAPFVAEYQAANRDHGKAVLLLRDGETVFEGTVKGVDG
                   250       260       270       280       290       300
                   310       320       330       340       350       360
    orf61a.pep    QGVLHLETAEGKQTVVSGEISLRSDDRPVSVPKRRDSERFLLLDGGNSRLKWAWVENGTF
                  ||||||||||||||||||||||||||||||||||||||||||||||||||||||||||||
    orf61-1       QGVLHLETAEGKQTVVSGEISLRSDDRPVSVPKRRDSERFLLLDGGNSRLKWAWVENGTF
                   310       320       330       340       350       360
                   370       380       390       400       410       420
    orf61a.pep    ATVGSAPYRDLSPLGAEWAEKVDGNVRIVGCAVCGEFKKAQVQEQLARKIEWLPSSAQAL
                  ||||||||||||||||||||||:|||||||||||||||||||||||||||||||||||||
    orf61-1       ATVGSAPYRDLSPLGAEWAEKADGNVRIVGCAVCGEFKKAQVQEQLARKIEWLPSSAQAL
                   370       380       390       400       410       420
```

```
                  430       440       450       460       470       480
orf61a.pep   GIRNHYRHPEEHGSDRWFNALGSRRFSRNACVVVSCGTAVTVDALTDDGHYLGGTIMPGF
             ||||||||||||||||||||||||||||||||||||||||||||||||||||||||||||
orf61-1      GIRNHYRHPEEHGSDRWFNALGSRRFSRNACVVVSCGTAVTVDALTDDGHYLGGTIMPGF
                  430       440       450       460       470       480
                  490       500       510       520       530       540
orf61a.pep   HLMKESLAVRTANLNRHAGKRYPFPTTTGNAVASGMMDAVCGSVMMMHGRLKEKTGAGKP
             ||||||||||||||||||||||||||||||||||||||||||||||||||||||||||||
orf61-1      HLMKESLAVRTANLNRHAGKRYPFPTTTGNAVASGMMDAVCGSVMMMHGRLKEKTGAGKP
                  490       500       510       520       530       540
                  550       560       570       580       590
orf61a.pep   VDVIITGGGAAKVAEALPPAFLAENTVRVADNLVIHGLLNLIAAEGGESEHTX
             |||||||||||||||||||||||||||||||||||:||||:||||||:||||X
orf61-1      VDVIITGGGAAKVAEALPPAFLAENTVRVADNLVIYGLLNMIAAEGREYEHIX
                  550       560       570       580       590
```

Homology with a Predicted ORF from *N. gonorrhoeae*

ORF61 shows 94.2% identity over a 189aa overlap with a predicted ORF (ORF61.ng) from *N. gonorrhoeae*:

```
orf61.pep                          EISLRSDXRPVSVXKRRDSERFLLLDGGNS   30
                                   |||||||:|||||| ||||:||||||||||:||||
orf61ng     TVCEGTVKGVDGRGVLHLETAEGEQTVVSGEISLRPDNRSVSVPKRPDSERFLLLEGGNS  211
orf61.pep   RLKWAWVENGTFATVGSAPYRDLSPLGAEWAEKADGNVRIVGCAVCGEFKKAQVQEQLAR   90
            ||||||||||||||||||||||||||||||||||||||||||||||:||||:|||||||
orf61ng     RLKWAWVENGTFATVGSAPYRDLSPLGAEWAEKADGNVRIVGCAVCGESKKAQVKEQLAR  271
orf61.pep   KIEWLPSSAQAXGIRNHYRHPEEHGSDRWFNALGSRRFSRNACVVVSCGTAVTVDALTDD  150
            |||||||||||:||||||||||||||||||||||||||||||||||||||||||||||||
orf61ng     KIEWLPSSAQALGIRNHYRHPEEHGSDRWFNALGSRRFSRNACVVVSCGTAVTVDALTDD  331
orf61.pep   GHYLGXGTIMPGFHLMKESLAVRTANLNRHAGKRYPFPT                       189
            ||||| ||||||||||||||||||||||||:|||||||||
orf61ng     GHYLG-GTIMPGFHLMKESLAVRTANLNRPAGKRYPFPTTTGNAVASGMMDAVCGSIMMM  390
```

An ORF61ng nucleotide sequence <SEQ ID 237> was predicted to encode a protein having amino acid sequence <SEQ ID 238>:

```
  1 MFSFGWAFDR PQYELGSLSP VAALACRRAL GCLGLETQIK
    WPNDLVVGRD

51 KLGGILIETV RAGGKTVAVV GIGINFVLPK EVENAASVQS
    LFQTASRRGN

101 ADAAVLLETL LAELGAVLEQ YAEEGFAPFL NEYETANRDH
    GKAVLLLRDG

151 ETVCEGTVKG VDGRGVLHLE TAEGEQTVVS GEISLRPDNR
    SVSVPKRPDS

201 ERFLLLEGGN SRLKWAWVEN GTFATVGSAP YRDLSPLGAE
    WAEKADGNVR

251 IVGCAVCGES KKAQVKEQLA RKIEWLPSSA QALGIRNHYR
    HPEEHGSDRW

301 FNALGSRRFS RNACVVVSCG TAVTVDALTD DGHYLGGTIM
    PGFHLMKESL

351 AVRTANLNRP AGKRYPFPTT TGNAVASGMM DAVCGSIMMM
    HGRLKEKNGA

401 GKPVDVIITG GGAAKVAEAL PPAFLAENTV RVADNLVIHG
    LLNLIAAEGG

451 ESEHA*
```

Further analysis revealed the complete gonococcal DNA sequence <SEQ ID 239> to be:

```
  1 ATGACGGTTT TGAAGCCTTC GCATTGGCGG GTGTTGGCGG AGCTTGCCGA

51 CGGTTTGCCG CAACACGTAT CGCAATTGGC GCGTGAGGCG GACATGAAGC

101 CGCAGCAGCT CAACGGTTTT TGGCAGCAGA TGCCGGCGCA TATACGCGGG

151 CTGTTGCGCC AACACGACGG CTATTGGCGG CTGGTGCGCC CCTTGGCGGT

201 TTTCGATGCC GAAGGTTTGC GCGATCTGGG GGAAAGGTCG GGTTTTCAGA

251 CGGCATTGAA GCACGAGTGC GCGTCCAGCA ACGACGAGAT ACTGGAATTG

301 GCGCGGATTG CGCCGGACAA GGCGCACAAA ACCATATGCG TGACCCACCT

351 GCAAAGTAAG GGCAGGGGGC GGCAGGGGCG GAAGTGGTCG CACCGTTTGG
```

-continued

```
 401 GCGAGTGCCT GATGTTCAGT TTCGGCTGGG CGTTTGACCG GCCGCAGTAT
 451 GAGTTGGGTT CGCTGTCGCC TGTTGCGGCA CTTGCGTGCC GGCGCGCTTT
 501 GGGGTGTTTG GGTTTGGAAA CGCAAATCAA GTGGCCAAAC GATTTGGTCG
 551 TCGGACGCGA CAAATTGGGC GGCATTCTGA TTGAAACAGT CAGGGCGGGC
 601 GGTAAAACGG TTGCCGTGGT CGGTATCGGC ATCAATTTCG TGCTGCCCAA
 651 GGAAGTGGAA AACGCCGCTT CCGTGCAGTC GCTGTTTCAG ACGGCATCGC
 701 GGCGGGGCAA TGCCGATGCC GCCGTATTGC TGGAAACATT GCTTGCGGAA
 751 CTGGGCGCGG TGTTGGAACA ATATGCGGAA GAAGGGTTCG CGCCATTTTT
 801 AAATGAGTAT GAAACGGCCA ACCGCGACCA CGGCAAGGCG GTATTGCTGT
 851 TGCGCGACGG CGAAACCGTG TGCGAAGGCA CGGTTAAAGG CGTGGACGGA
 901 CGAGGCGTTC TGCACTTGGA AACGGCAgaa ggcgaACAGa cggtcgtcag
 951 cggcgaaaTC AGcctGCggc ccgacaacaG GTCGGtttcc gtgccgaagc
1001 ggccggatTC GgaacgtTTT tTGCtgttgg aaggcgggaa cagccgGCTC
1051 AAGTGGGCGT GggtggAAAa cggcacgttc gcaaccgtgg gcagcgcgCc
1101 gtaCCGCGAT TTGTCGCCTT TGGGCGCGGA GTGGGCGGAA AAGGCGGATG
1151 GAAATGTCCG CATCGTCGGT TGCGCCGTGT GCGGAGAATC CAAAAAGGCA
1201 CAAGTGAAGG AACAGCTCGC CGAAAAATC GAGTGGCTGC CGTCTTCCGC
1251 ACAGGCTTTG GGCATACGCA ACCACTACCG CCACCCCGAA GAACACGGTT
1301 CCGACCGTTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGCG AACCATCAT GCCCGGCTTC CACCTGATGA
1451 AAGAATCGCT CGCCGTCCGA ACCGCCAACC TCAACCGCCC CGCCGGCAAA
1501 CGTTACCCTT TCCCGACCAC AACGGGCAAC GCCGTCGCAA GCGGCATGAT
1551 GGACGCGGTT GCGGCTCGA TAATGATGAT GCACGGCCGT TTGAAAGAAA
1601 AAAACGGCGC GGGCAAGCCT GTCGATGTCA TCATTACCGG CGGCGGCGCG
1651 GCGAAAGTCG CCGAAGCCCT GCCGCCTGCA TTTTTGGCGG AAAATACCGT
1701 GCGCGTGGCG GACAACCTCG TCATCCACGG GCTGCTGAAC CTGATTGCCG
1751 CCGAAGGCGG GGAATCGGAA CACGCTTAA
```

This corresponds to the amino acid sequence <SEQ ID 240; ORF61ng-1>:

```
  1 MTVLKPSHWR VLAELADGLP QHVSQLAREA DMKPQQLNGF WQQMPAHIRG
 51 LLRQHDGYWR LVRPLAVFDA EGLRDLGERS GFQTALKHEC ASSNDEILEL
101 ARIAPDKAHK TICVTHLQSK GRGRQGRKWS HRLGECLMFS FGWAFDRPQY
151 ELGSLSPVAA LACRRALGCL GLETQIKWPN DLVVGRDKLG GILIETVRAG
201 GKTVAVVGIG INFVLPKEVE NAASVQSLFQ TASRRGNADA AVLLETLLAE
251 LGAVLEQYAE EGFAPFLNEY ETANRDHGKA VLLLRDGETV CEGTVKGVDG
301 RGVLHLETAE GEQTVVSGEI SLRPDNRSVS VPKRPDSERF LLLEGGNSRL
351 KWAWVENGTF ATVGSAPYRD LSPLGAEWAE KADGNVRIVG CAVCGESKKA
401 QVKEQLARKI EWLPSSAQAL GIRNHYRHPE EHGSDRWFNA LGSRRFSRNA
```

-continued

```
451 CVVVSCGTAV TVDALTDDGH YLGGTIMPGF HLMKESLAVR TANLNRPAGK

501 RYPFPTTTGN AVASGMMDAV CGSIMMMHGR LKEKNGAGKP VDVIITGGGA

551 AKVAEALPPA FLAENTVRVA DNLVIHGLLN LIAAEGGESE HA*
```

ORF61ng-1 and ORF61-1 show 93.9% identity in 591 aa overlap:

```
orf61ng-1.pep  MTVLKPSHWRVLAELADGLPQHVSQLAREADMKPQQLNGFWQQMPAHIRGLLRQHDGYWR   60
               ||||| |||||||||||||||||||||| |||||||||||||||||||||||||||||||
orf61-1        MTVLKLSHWRVLAELADGLPQHVSQLARMADMKPQQLNGFWQQMPAHIRGLLRQHDGYWR   60
orf61ng-1.pep  LVRPLAVFDAEGLRDLGERSGFQTALKHECASSNDEILELARIAPDKAHKTICVTHLQSK  120
               |||||||||||||:||||||||||||||||||||||||||||||||||||||||||||||
orf61-1        LVRPLAVFDAEGLRELGERSGFQTALKHECASSNDEILELARIAPDKAHKTICVTHLQSK  120
orf61ng-1.pep  GRGRQGRKWSHRLGECLMFSFGWAFDRPQYELGSLSPVAALACRRALGCLGLETQIKWPN  180
               |||||||||||||||||||||||:||||||||||||||||:||||||: |||::||||||
orf61-1        GRGRQGRKWSHRLGECLMFSFGWVFDRPQYELGSLSPVAAVACRRALSRLGLDVQIKWPN  180
orf61ng-1.pep  DLVVGRDKLGGILIETVRAGGKTVAVVGIGINFVLPKEVENAASVQSLFQTASRRGNADA  240
               ||||||||||||||||||:|||||||||||||||||||||||||||||||||||||||||
orf61-1        DLVVGRDKLGGILIETVRTGGKTVAVVGIGINFVLPKEVENAASVQSLFQTASRRGNADA  240
orf61ng-1.pep  AVLLETLLAELGAVLEQYAEEGFAPFLNEYETANRDHGKAVLLLRDGETVCEGTVKGVDG  300
               ||||||||:|| ||| |||::|||||: ||::|||||||||||||||||| |||||||||
orf61-1        AVLLETLLVELDAVLLQYARDGFAPFVAEYQAANRDHGKAVLLLRDGETVFEGTVKGVDG  300
orf61ng-1.pep  RGVLHLETAEGEQTVVSGEISLRPDNRSVSVPKRPDSERFLLLEGGNSRLKWAWVENGTF  360
               :||||||||||:||||||||||| |:| |||||| ||||||||:||||||||||||||||
orf61-1        QGVLHLETAEGKQTVVSGEISLRSDDRPVSVPKRRDSERFLLLDGGNSRLKWAWVENGTF  360
orf61ng-1.pep  ATVGSAPYRDLSPLGAEWAEKADGNVRIVGCAVCGESKKAQVKEQLARKIEWLPSSAQAL  420
               |||||||||||||||||||||||||||||||||||| |||||:|||||||||||||||||
orf61-1        ATVGSAPYRDLSPLGAEWAEKADGNVRIVGCAVCGEFKKAQVQEQLARKIEWLPSSAQAL  420
orf61ng-1.pep  GIRNHYRHPEEHGSDRWFNALGSRRFSRNACVVVSCGTAVTVDALTDDGHYLGGTIMPGF  480
               ||||||||||||||||||||||||||||||||||||||||||||||||||||||||||||
orf61-1        GIRNHYRHPEEHGSDRWFNALGSRRFSRNACVVVSCGTAVTVDALTDDGHYLGGTIMPGF  480
orf61ng-1.pep  HLMKESLAVRTANLNRPAGKRYPFPTTTGNAVASGMMDAVCGSIMMMHGRLKEKNGAGKP  540
               |||||||||||||||| ||||||||||||||||||||||||||:||||||||||:|||||
orf61-1        HLMKESLAVRTANLNRHAGKRYPFPTTTGNAVASGMMDAVCGSVMMMHGRLKEKTGAGKP  540
orf61ng-1.pep  VDVIITGGGAAKVAEALPPAFLAENTVRVADNLVIHGLLNLIAAEGGESEHAX    593
               |||||||||||||||||||||||||||||||||||:||||:||||| | ||
orf61-1        VDVIITGGGAAKVAEALPPAFLAENTVRVADNLVIYGLLNMIAAEGREYEHIX    593
```

Based on this analysis, including the homology with the baf protein of *B. pertussis* and the presence of a putative prokaryotic membrane lipoprotein lipid attachment site, it is predicted that these proteins from *N. meningitidis* and *N. gonorrhoeae*, and their epitopes, could be useful antigens for vaccines or diagnostics, or for raising antibodies.

Example 29

The following partial DNA sequence was identified in *N. meningitidis* <SEQ ID 241>:

```
  1 ATGTTTTACC AAATCCTTGC CCTGATTATC TGGAGCAGCT CGTTTATTGC

51 CGCCAAATAT GTCTATGGCG GCATCGATCC CGCATTGATG GTCGGCGTGC

101 GCCTGCTAAT TGCCGCGCTG CCTGCACTGC CCGCCTGCCG CCGTCATGTC

151 GGCAAGATTC CGCGTGAGGA ATGGAAGCCG TTGCTGATTG TGTCGTTCGT

201 CAACTATGTG CTGACCCTGC TGCTTCAGTT TGTCGGGTTG AAATACACTT

251 CCGCCGCCAG CGCATCGGTC ATTGTCGGAC TCGAGCCGCT GCTGATGGTG

301 TTTGTCGGAC ACTTTTTCTT CAACGACAAA GCGCGTGCCT ACCACTGGAT

351 ATGCGGCGCG GCGGCATTTG CCGGTGTCGC GCTGCTGATG GCGGGCGGTG
```

```
401 CGGaAGAGGG CGGCGaAGTC GGCTGGTTCG GCTGCCTGCT GGTGTTGTTG

451 GCGGGCGCGG GCTTTTGTGC CGCTATGCGT CCGACGCAAA GGCTGATTGC

501 ACGCATCGGC GCACCGGCAT TCACATCTGT TTCCATTGCC GCCGCATCCT

551 TGATGTGCCT GCCGTTTTCG CTTGCTTTGG CGCAAAGTTA TACCGTGGAC

601 TGGAGCGTCG GGATGGTATT GTCGCTGCTG TATTTGGGTT TGGGGTGC..
```

This corresponds to the amino acid sequence <SEQ ID 242; ORF62>:

```
  1 MFYQILALII WSSSFIAAKY VYGGIDPALM VGVRLLIAAL PALPACRRHV

51 GKIPREEWKP LLIVSFVNYV LTLLLQFVGL KYTSAASASV IVGLEPLLMV

101 FVGHFFFNDK ARAYHWICGA AAFAGVALLM AGGAEEGGEV GWFGCLLVLL

151 AGAGFCAAMR PTQRLIARIG APAFTSVSIA AASLMCLPFS LALAQSYTVD

201 WSVGMVLSLL YLGLGC..
```

Further work revealed the complete nucleotide sequence <SEQ ID 243>:

```
  1 ATGTTTTACC AAATCCTTGC CCTGATTATC TGGAGCAGCT CGTTTATTGC

51 CGCCAAATAT GTCTATGGCG GCATCGATCC CGCATTGATG GTCGGCGTGC

101 GCCTGCTAAT TGCCGCGCTG CCTGCACTGC CCGCCTGCCG CCGTCATGTC

151 GGCAAGATTC CGCGTGAGGA ATGGAAGCCG TTGCTGATTG TGTCGTTCGT

201 CAACTATGTG CTGACCCTGC TGCTTCAGTT TGTCGGGTTG AAATACACTT

251 CCGCCGCCAG CGCATCGGTC ATTGTCGGAC TCGAGCCGCT GCTGATGGTG

301 TTTGTCGGAC ACTTTTTCTT CAACGACAAA GCGCGTGCCT ACCACTGGAT

351 ATGCGGCGCG GCGGCATTTG CCGGTGTCGC GCTGCTGATG GCGGGCGGTG

401 CGGAAGAGGG CGGCGAAGTC GGCTGGTTCG GCTGCCTGCT GGTGTTGTTG

451 GCGGGCGCGG GCTTTTGTGC CGCTATGCGT CCGACGCAAA GGCTGATTGC

501 ACGCATCGGC GCACCGGCAT TCACATCTGT TTCCATTGCC GCCGCATCGT

551 TGATGTGCCT GCCGTTTTCG CTTGCTTTGG CGCAAAGTTA TACCGTGGAC

601 TGGAGCGTCG GGATGGTATT GTCGCTGCTG TATTTGGGTT TGGGGTGCGG

651 CTGGTACGCC TATTGGCTGT GGAACAAGGG GATGAGCCGT GTTCCTGCCA

701 ATGTTTCGGG ACTGTTGATT TCGCTCGAAC CCGTCGTCGG CGTGCTGCTG

751 GCGGTTTTGA TTTTGGGCGA ACACCTGTCG CCCGTGTCCG CCTTGGGCGT

801 GTTTGTCGTC ATCGCCGCCA CCTTGGTTGC CGGCCGGCTG TCGCATCAAA

851 AATAA
```

This corresponds to the amino acid sequence <SEQ ID 244; ORF62-1>:

```
  1 MFYQILALII WSSSFIAAKY VYGGIDPALM VGVRLLIAAL PALPACRRHV

51 GKIPREEWKP LLIVSFVNYV LTLLLQFVGL KYTSAASASV IVGLEPLLMV
```

-continued

```
101 FVGHFFFNDK ARAYHWICGA AAFAGVALLM AGGAEEGGEV GWFGCLLVLL

151 AGAGFCAAMR PTQRLIARIG APAFTSVSIA AASLMCLPFS LALAQSYTVD

201 WSVGMVLSLL YLGLGCGWYA YWLWNKGMSR VPANVSGLLI SLEPVVGVLL

251 AVLILGEHLS PVSALGVFVV IAATLVAGRL SHQK*
```

Computer analysis of this amino acid sequence gave the following results:

Homology with Hypothetical Transmembrane Protein HI0976 of *H. influenzae* (Accession Number Q57147)

ORF62 and HI0976 show 50% aa identity in 114aa overlap:

```
Orf62    1 MFYQILALIIWSSSFIAAKYVYGGIDPALMVGVRXXXXXXXXXXXXCRRHVGKIPREEWKP   60
           M YQILAL+IWSSS I   K  Y +DP L+V VR          R   KI +    K
HI0976   1 MLYQILALLIWSSSLIVGKLTYSMMDPVLVVQVRLIIAMIIVMPLFLRRWKKIDKPMRKQ   60

Orf62   61 LLIVSFVNYVLTLLLQFVGLKYTSAASASVIVGLEPLLMVFVGHFFFNDKARAY       114
           L  ++F NY    LLQF+GLKYTSA+SA  ++GLEPLL+VFVGHFFF  K   +
HI0976  61 LWWLAFFNYTAVFLLQFIGLKYTSASSAVTMIGLEPLLVVFVGHFFFKTKQNGF       114
```

Homology with a Predicted ORF from *N. meningitidis* (Strain A)

ORF62 shows 99.5% identity over a 216aa overlap with an ORF (ORF62a) from strain A of *N. meningitidis*:

```
                    10         20         30         40         50         60
orf62.pep  MFYQILALIIWSSSFIAAKYVYGGIDPALMVGVRLLIAALPALPACRRHVGKIPREEWKP
           ||||||||||||||||||||||||||||||||||||||||||||||||||||||||||||
orf62a     MFYQILALIIWSSSFIAAKYVYGGIDPALMVGVRLLIAALPALPACRRHVGKIPREEWKP
                    10         20         30         40         50         60
                    70         80         90        100        110        120
orf62.pep  LLIVSFVNYVLTLLLQFVGLKYTSAASASVIVGLEPLLMVFVGHFFFNDKARAYHWICGA
           ||||||||||||||||||||||||||||||||||||||||||||||||||||||||||||
orf62a     LLIVSFVNYVLTLLLQFVGLKYTSAASASVIVGLEPLLMVFVGHFFFNDKARAYHWICGA
                    70         80         90        100        110        120
                   130        140        150        160        170        180
orf62.pep  AAFAGVALLMAGGAEEGGEVGWFGCLLVLLAGAGFCAAMRPTQRLIARIGAPAFTSVSIA
           ||||||||||||||||||||||||||||||||||||||||||||||||||||||||||||
orf62a     AAFAGVALLMAGGAEEGGEVGWFGCLLVLLAGAGFCAAMRPTQRLIARIGAPAFTSVSIA
                   130        140        150        160        170        180
                   190        200        210
orf62.pep  AASLMCLPFSLALAQSYTVDWSVGMVLSLLYLGLGC
           |||||||||||||||||||||||||||||||:||
orf62a     AASLMCLPFSLALAQSYTVDWSVGMVLSLLYLGVGCSWYAYWLWNKGMSRVPANVSGLLI
                   190        200        210        220        230        240
orf62a     SLEPVVGVLLAVLILGEHLSPVSVLGVFVVIAATLVAGRLSHQKX
                   250        260        270        280
```

The complete length ORF62a nucleotide sequence <SEQ ID 245> is:

```
  1 ATGTTTTACC AAATCCTTGC CCTGATTATC TGGAGCAGCT CGTTTATTGC

51 CGCCAAATAT GTCTATGGCG GCATCGATCC CGCATTGATG GTCGGCGTGC

101 GCCTGCTGAT TGCTGCGCTG CCTGCACTGC CCGCCTGCCG CCGTCATGTC

151 GGCAAGATTC CGCGTGAGGA ATGGAAGCCG TTGCTGATTG TGTCGTTCGT

201 CAACTATGTG CTGACCCTGC TACTTCAGTT TGTCGGGTTG AAATACACTT

251 CCGCCGCCAG CGCATCGGTC ATTGTCGGAC TCGAGCCACT GCTGATGGTG

301 TTTGTCGGAC ACTTTTTCTT CAACGACAAA GCGCGTGCCT ACCACTGGAT
```

```
351 ATGCGGCGCG GCGGCATTTG CCGGTGTCGC GCTGCTGATG GCGGGCGGTG

401 CGGAAGAGGG CGGCGAAGTC GGCTGGTTCG GCTGCCTGCT GGTGTTGTTG

451 GCGGGCGCGG GCTTTTGTGC CGCTATGCGT CCGACGCAAA GGCTGATTGC

501 ACGCATCGGC GCACCGGCAT TCACATCTGT TTCCATTGCC GCCGCATCGT

551 TGATGTGCCT GCCGTTTTCG CTTGCTTTGG CGCAAAGTTA TACCGTGGAC

601 TGGAGCGTCG GAATGGTATT GTCGCTGCTG TATTTGGGCG TGGGGTGCAG

651 CTGGTACGCC TATTGGCTGT GGAACAAGGG GATGAGCCGT GTTCCTGCCA

701 ACGTTTCGGG ACTGTTGATT TCGCTCGAAC CCGTCGTCGG CGTGCTGCTG

751 GCGGTTTTGA TTTTGGGCGA ACACCTGTCG CCCGTGTCCG TCTTGGGCGT

801 GTTTGTCGTC ATCGCCGCCA CCTTGGTTGC CGGCCGGCTG TCGCATCAAA

851 AATAA
```

This encodes a protein having amino acid sequence <SEQ ID 246>:

```
  1 MFYQILALII WSSSFIAAKY VYGGIDPALM VGVRLLIAAL PALPACRRHV

51 GKIPREEWKP LLIVSFVNYV LTLLLQFVGL KYTSAASASV IVGLEPLLMV

101 FVGHFFFNDK ARAYHWICGA AAFAGVALLM AGGAEEGGEV GWFGCLLVLL

151 AGAGFCAAMR PTQRLIARIG APAFTSVSIA AASLMCLPFS LALAQSYTVD

201 WSVGMVLSLL YLGVGCSWYA YWLWNKGMSR VPANVSGLLI SLEPVVGVLL

251 AVLILGEHLS PVSVLGVFVV IAATLVAGRL SHQK*
```

ORF62a and ORF62-1 show 98.9% identity in 284 aa overlap:

```
orf62a.pep   MFYQILALIIWSSSFIAAKYVYGGIDPALMVGVRLLIAALPALPACRRHVGKIPREEWKP    60
             ||||||||||||||||||||||||||||||||||||||||||||||||||||||||||||
orf62-1      MFYQILALIIWSSSFIAAKYVYGGIDPALMVGVRLLIAALPALPACRRHVGKIPREEWKP    60
orf62a.pep   LLIVSFVNYVLTLLLQFVGLKYTSAASASVIVGLEPLLMVFVGHFFFNDKARAYHWICGA   120
             ||||||||||||||||||||||||||||||||||||||||||||||||||||||||||||
orf62-1      LLIVSFVNYVLTLLLQFVGLKYTSAASASVIVGLEPLLMVFVGHFFFNDKARAYHWICGA   120
orf62a.pep   AAFAGVALLMAGGAEEGGEVGWFGCLLVLLAGAGFCAAMRPTQRLIARIGAPAFTSVSIA   180
             ||||||||||||||||||||||||||||||||||||||||||||||||||||||||||||
orf62-1      AAFAGVALLMAGGAEEGGEVGWFGCLLVLLAGAGFCAAMRPTQRLIARIGAPAFTSVSIA   180
orf62a.pep   AASLMCLPFSLALAQSYTVDWSVGMVLSLLYLGVGCSWYAYWLWNKGMSRVPANVSGLLI   240
             |||||||||||||||||||||||||||||||||:||:|||||||||||||||||||||||
orf62-1      AASLMCLPFSLALAQSYTVDWSVGMVLSLLYLGLGCGWYAYWLWNKGMSRVPANVSGLLI   240
orf62a.pep   SLEPVVGVLLAVLILGEHLSPVSVLGVFVVIAATLVAGRLSHQKX    285
             |||||||||||||||||||||||:|||||||||||||||||||||
orf62-1      SLEPVVGVLLAVLILGEHLSPVSALGVFVVIAATLVAGRLSHQKX    285
```

Homology with a Predicted ORF from *N. gonorrhoeae*

ORF62 shows 99.5% identity over a 216aa overlap with a predicted ORF (ORF62.ng) from *N. gonorrhoeae*:

```
orf62.pep   MFYQILALIIWSSSFIAAKYVYGGIDPALMVGVRLLIAALPALPACRRHVGKIPREEWKP    60
            |||||||||||:||||||||||||||||||||||||||||||||||||||||||||||||
orf62ng     MFYQILALIIWGSSFIAAKYVYGGIDPALMVGVRLLIAALPALPACRRHVGKIPREEWKP    60
```

```
orf62.pep  LLIVSFVNYVLTLLLQFVGLKYTSAASASVIVGLEPLLMVFVGHFFFNDKARAYHWICGA  120
           ||||||||||||||||||||||||||||||||||||||||||||||||||||||||||||
orf62ng    LLIVSFVNYVLTLLLQFVGLKYTSAASASVIVGLEPLLMVFVGHFFFNDKARAYHWICGA  120 orf62.pep  AAFAGVALLMAGGAEEGGEVGWFGCLLVLLAGAGFCAAMRPTQRLIARIGAPAFTSVSIA  180
           ||||||||||||||||||||||||||||||||||||||||||||||||||||||||||||
orf62ng    AAFAGVALLMAGGAEEGGEVGWFGCLLVLLAGAGFCAAMRPTQRLIARIGAPAFTSVSIA  180 orf62.pep  AASLMCLPFSLALAQSYTVDWSVGMVLSLLYLGLGC                          216
           |||||||||||||||||||||||||||||||||||
orf62ng    AASLMCLPFSLALAQSYTVDWSVGMVLSLLYLGLGCGWYAYWLWNKGMSRVPANASGLLI  240
```

The complete length ORF62ng nucleotide sequence <SEQ ID 247> is:

```
  1 ATGTTTTACC AAATCCTTGC CCTGATTATC TGGGGCAGCT CGTTTATTGC
 51 CGCCAAATAT GTCTATGGCG GCATCGATCC CGCATTGATG GTCGGCGTGC
101 GCCTGCTGAT TGCCGCGCTG CCTGCACTGC CCGCCTGCCG CCGTCATGTC
151 GGCAAGATTC CGCGTGAGGA ATGGAAGCCG TTGCTGATTG TGTCGTTCGT
201 CAACTATGTG CTGACCCTGC TGCTTCAGTT TGTCGGGTTG AAATACACTT
251 CCGCCGCCAG CGCATCGGTC ATTGTCGGAC TCGAGCCGCT GCTGATGGTG
301 TTTGTCGGAC ACTTTTTCTT CAACGACAAA GCGCGTGCCT ACCACTGGAT
351 ATGCGGCGCG GCGGCATTTG CCGGTGTCGC GCTGCTGATG GCGGGCGGTG
401 CGGAAGAGGG CGGCGAAGTC GGCTGGTTCG GCTGCCTGCT GGTGTTGTTG
451 GCGGGCGCGG GCTTTTGTGC CGCTATGCGT CCGACGCAAA GGCTGATTGC
501 CCGCATCGGC GCACCGGCAT TCACATCTGT TTCCATTGCC GCCGCATCGT
551 TGATGTGCCT GCCGTTTTCG CTTGCTTTGG CGCAAAGTTA TACCGTGGAC
601 TGGAGCGTCG GGATGGTATT GTCGCTGTTG TATTTGGGTT TGGGGTGCGG
651 CTGGTACGCC TATTGGCTGT GGAACAAGGG GATGAGCCGT GTTCCTGCCA
701 ACGCGTCGGG ACTGTTGATT TCGCTCGAAC CCGTCGTCGC CGTGCTGTTG
751 GCGGTTTTGA TTTTGGGCGA ACATTTATCG CCCGTGTCCG CCTTGGGCGT
801 GTTTGTCGTC ATCGCCGCCA CTTTCGCCGC CGGCCGGCTG TCGCGCAGGG
851 ACGCGCAAAA CGGCAATGCC GTCTGA
```

This encodes a protein having amino acid sequence <SEQ ID 248>:

```
  1 MFYQILALII WGSSFIAAKY VYGGIDPALM VGVRLLIAAL PALPACRRHV
 51 GKIPREEWKP LLIVSFVNYV LTLLLQFVGL KYTSAASASV IVGLEPLLMV
101 FVGHFFFNDK ARAYHWICGA AAFAGVALLM AGGAEEGGEV GWFGCLLVLL
151 AGAGFCAAMR PTQRLIARIG APAFTSVSIA AASLMCLPFS LALAQSYTVD
201 WSVGMVLSLL YLGLGCGWYA YWLWNKGMSR VPANASGLLI SLEPVVGVLL
251 AVLILGEHLS PVSALGVFVV IAATFAAGRL SRRDAQNGNA V*
```

ORF62ng and ORF62-1 show 97.9% identity in 283 aa overlap:

```
          10         20         30         40         50         60
orf62ng.pep  MFYQILALIIWGSSFIAAKYVYGGIDPALMVGVRLLIAALPALPACRRHVGKIPREEWKP
             ||||||||||:|||||||||||||||||||||||||||||||||||||||||||||||||
orf62-1      MFYQILALIIWSSSFIAAKYVYGGIDPALMVGVRLLIAALPALPACRRHVGKIPREEWKP
          10         20         30         40         50         60
          70         80         90        100        110        120
orf62ng.pep  LLIVSFVNYVLTLLLQFVGLKYTSAASASVIVGLEPLLMVFVGHFFFNDKARAYHWICGA
             ||||||||||||||||||||||||||||||||||||||||||||||||||||||||||||
orf62-1      LLIVSFVNYVLTLLLQFVGLKYTSAASASVIVGLEPLLMVFVGHFFFNDKARAYHWICGA
          70         80         90        100        110        120
         130        140        150        160        170        180
orf62ng.pep  AAFAGVALLMAGGAEEGGEVGWFGCLLVLLAGAGFCAAMRPTQRLIARIGAPAFTSVSIA
             ||||||||||||||||||||||||||||||||||||||||||||||||||||||||||||
orf62-1      AAFAGVALLMAGGAEEGGEVGWFGCLLVLLAGAGFCAAMRPTQRLIARIGAPAFTSVSIA
         130        140        150        160        170        180
         190        200        210        220        230        240
orf62ng.pep  AASLMCLPFSLALAQSYTVDWSVGMVLSLLYLGLGCGWYAYWLWNKGMSRVPANASGLLI
             |||||||||||||||||||||||||||||||||||||||||||||||||||||::|||||
orf62-1      AASLMCLPFSLALAQSYTVDWSVGMVLSLLYLGLGCGWYAYWLWNKGMSRVPANVSGLLI
         190        200        210        220        230        240
         250        260        270        280        290
orf62ng.pep  SLEPVVGVLLAVLILGEHLSPVSALGVFVVIAATFAAGRLSRRDAQNGNAVX
             |||||||||||||||||||||||||||||||||::||||::
orf62-1      SLEPVVGVLLAVLILGEHLSPVSALGVFVVIAATLVAGRLSHQKX
         250        260        270        280
```

Furthermore, ORF62ng snows significant homology to a hypothetical *H. influenzae* protein:

```
sp|Q57147|Y976_HAEIN HYPOTHETICAL PROTEIN HI0976 >gi|1074589|pir|IB64163
hypothetical protein HI0976 - Haemophilus influenzae (strain Rd KW20)
>gi|1574004 (U32778) hypothetical [Haemophilus influenzae] Length = 128
Score = 106 bits (262), Expect = 2e-22
Identities = 56/114 (49%), Positives = 68/114 (59%)

Query:    1 MFYQILALIIWGSSFIAAKYVYGGIDPALNVGVRXXXXXXXXXXXXXCRRHVGKIPREEWKP   60
            M YQILAL+IW SS I  K Y +DP L+V VR         R   KI +   K
Sbjct:    1 MLYQILALLIWSSSLIVGKLTYSMMDPVLVVQVRLIIAMIIVMPLFLRRWKKIDKPMRKQ   60

Query:   61 LLIVSFVNYVLTLLLQFVGLKYTSAASASVIVGLEPLLMVFVGHFFFNDKARAY       114
            L ++F NY    LLQF+GLKYTSA+SA  ++GLEPLL+VFVGHFFF K   +
Sbjct:   61 LWWLAFFNYTAVFLLQFIGLKYTSASSAVTMIGLEPLLVVFVGHFFFKTKQNGF        114
```

Based on this analysis, including the homology with the transmembrane protein of *H. influenzae* and the putative leader sequence and several transmembrane domains in the gonococcal protein, it is predicted that these proteins from *N. meningitidis* and *N. gonorrhoeae*, and their epitopes, could be useful antigens for vaccines or diagnostics, or for raising antibodies.

Example 30

The following partial DNA sequence was identified in *N. meningitidis* <SEQ ID 249>:

```
  1 ATGCGCCGTT TTCTACCGAT CGCAGCCATA TGCGCmGwms
    TCCTGkkGTA 51 sGGACTGACG GCGGCAACCG GCAGCACCAG TTCGCTGGCG
    GATTATTTCT

101 GGTGGATTGT TGCGTTCAGC GCAATGCTGC TGCTGGTGTT
    GTCCGCCGTT

151 TTGGCACGTT ATGTCATATT GCTGTTGAAA GACAGGCGCG
    ACCGCGTATT

201 CGGTTCGCtA srTyGCCAAA gsGCCTgkks TGGG.ATGTT
    TACGCTGGTT

251 GCCCkACTGC CCGGCGTGTT TCTGTTCGGC TTTCCCGCAC
    AGTTCATCAA

301 CGGCACGATT AATTCGTGGT TCGGCAACGA TACCCACGAG
    GCGCTTGAAC

351 GCAGCCTCAA TTTGAGCAAG TCCGCATTGA ATTTGGCGGC
    AGACAACGCC

401 CTCGGCAACG CCGTCCCCGT GCAGATAGAC CTCATCGGCG
    CGGCTTCCCT

451 GCCCGGGGAT ATGGGCAGGG TGCTGGAACA TTACGCCGGC
    AGCGGTTTTG

501 CCCAGCTTGC CCTGTACAAy ksCGCAAGCG GCAAAATCGA
    AAAAAGCATC

551 AACCCGCACA AGCTCGATCA GCCGTTTCCA GGTAAGGCGC
    GTTGGGAaAa

601 AATCCaACGG GCGGGTTCGG TCAGGGATTT GGAAAGCATA
    GGCGGCGTAT

651 TGTaCGCGCA GGGCTGGCTG TCGGCGGGTA CGCACwACGG
    GCGCGATTAC

701 GCCTTGTTTT TCCGTCAGCC GGTTCCCAAA GGCGTGGCAG
    AGGATGCCGT
```

```
751  yTTAATCGAA AAGGCAAGGG CGAAATATGC TGAGTTGAGT
     TACAGCAAAA

801  AAGGTTTGCA GACCTTTTTC CTGGCAACCC TGCTGATTGC
     CTCGCTGCTG

851  TCGATTTTTC TTGCACTGGT CATGGCACTG TATTTCGCCC
     GCCGTTTCGT

901  CGAACCCGTC CTATCGCTTG CCGAGGGGGC GAAGGCGGTG
     GCGCAAGGCG

951  ATTTCAGCCA GACGCGCCCC GTGTTGCGCA ACGACGAGTT
     CCGACGCTTG

1001 ACCArGTTGT TCAACCACAT GACCGAGCAG CTTTCCATCG
     CCAAAGATGC

1051 AGACGAGCGC AACCGCCGGC GCGAGGAAGC CGCCAGGCAT
     TATCTTGAAT

1101 GCGTGTTGGA GGGGCTGACC ACGGGCGTGG TGGTGTTTGA
     CGAACAAGGC

1151 TGTCTGAAAA CCTTCAACAA AGCGGCGGGT ACC . . .
```

This corresponds to the amino acid sequence <SEQ ID 250; ORF64>:

```
 1  MRRFLPIAAI CAXXLXXGLT AATGSTSSLA DYFWWIVAFS
    AMLLLVLSAV

51  LARYVILLLK DRRDGVFGSX XAKXPXXXMF TLVAXLPGVF
    LFGFPAQFIN

101 GTINSWFGND THEALERSLN LSKSALNLAA DNALGNAVPV
    QIDLIGAASL

151 PGDMGRVLEH YAGSGFAQLA LYNXASGKIE KSINPHKLDQ
    PFPGKARWEK

201 IQRAGSVRDL ESIGGVLYAQ GWLSAGTHXG RDYALFFRQP
    VPKGVAEDAV

251 LIEKARAKYA ELSYSKKGLQ TFFLATLLIA SLLSIFLALV
    MALYFARRFV

301 EPVLSLAEGA KAVAQGDFSQ TRPVLRNDEF GRLTXLFNHM
    TEQLSIAKDA

351 DERNRRREEA ARHYLECVLE GLTTGVVVFD EQGCLKTFNK
    AAGT . . .
```

Further work revealed the complete nucleotide sequence <SEQ ID 251>:

```
  1  ATGCGCCGTT TTCTACCGAT CGCAGCCATA TGCGCCGTCG
     TCCTGTTGTA

51  CGGACTGACG GCGGCAACCG GCAGCACCAG TTCGCTGGCG
     GATTATTTCT

101  GGTGGATTGT TGCGTTCAGC GCAATGCTGC TGCTGGTGTT
     GTCCGCCGTT

151  TTGGCACGTT ATGTCATATT GCTGTTGAAA GACAGGCGCG
     ACGGCGTATT

201  CGGTTCGCAG ATTGCCAAAC GCCTTTCTGG GATGTTTACG
     CTGGTTGCCG

251  TACTGCCCGG CGTGTTTCTG TTCGGCGTTT CCGCACAGTT
     CATCAACGGC

301  ACGATTAATT CGTGGTTCGG CAACGATACC CACGAGGCGC
     TTGAACGCAG

351  CCTCAATTTG AGCAAGTCCG CATTGAATTT GGCGGCAGAC
     AACGCCCTCG

401  GCAACGCCGT CCCCGTGCAG ATAGACCTCA TCGGCGCGGC
     TTCCCTGCCC

451  GGGGATATGG GCAGGGTGCT GGAACATTAC GCCGGCAGCG
     GTTTTGCCCA

501  GCTTGCCCTG TACAATGCCG CAAGCGGCAA AATCGAAAAA
     AGCATCAACC

551  CGCACAAGCT CGATCAGCCG TTTCCAGGTA AGGCGCGTTG
     GGAAAAAATC

601  CAACGGGCGG GTTCGGTCAG GGATTTGGAA AGCATAGGCG
     GCGTATTGTA

651  CGCGCAGGGC TGGCTGTCGG CGGGTACGCA CAACGGGCGC
     GATTACGCCT

701  TGTTTTTCCG TCAGCCGGTT CCCAAAGGCG TGGCAGAGGA
     TGCCGTCTTA

751  ATCGAAAAGG CAAGGGCGAA ATATGCTGAG TTGAGTTACA
     GCAAAAAAGG

801  TTTGCAGACC TTTTTCCTGG CAACCCTGCT GATTGCCTCG
     CTGCTGTCGA

851  TTTTTCTTGC ACTGGTCATG GCACTGTATT TCGCCCGCCG
     TTTCGTCGAA

901  CCCGTCCTAT CGCTTGCCGA GGGGGCGAAG GCGGTGGCGC
     AAGGCGATTT

951  CAGCCAGACG CGCCCCGTGT TGCGCAACGA CGAGTTCGGA
     CGCTTGACCA

1001 AGTTGTTCAA CCACATGACC GAGCAGCTTT CCATCGCCAA
     AGAAGCAGAC

1051 GAGCGCAACC GCCGGCGCGA GGAAGCCGCC AGGCATTATC
     TTGAATGCGT

1101 GTTGGAGGGG CTGACCACGG GCGTGGTGGT GTTTGACGAA
     CAAGGCTGTC

1151 TGAAAACCTT CAACAAAGCG GCGGAACAGA TTTTGGGGAT
     GCCGCTTACC

1201 CCCCTGTGGG GCAGCAGCCG GCACGGTTGG CACGGCGTTT
     CGGCGCAGCA

1251 GTCCCTGCTT GCCGAAGTGT TTGCCGCCAT CGGCGCGGCG
     GCAGGTACGG

1301 ACAAACCGGT CCATGTGAAA TATGCCGCGC CGGACGATGC
     CAAAATCCTG

1351 CTGGGCAAGG CAACCGTCCT GCCCGAAGAC AACGGCAACG
     GCGTGGTAAT

1401 GGTGATTGAC GACATCACCG TTTTGATACA CGCGCAAAAA
     GAAGCCGCGT

1451 GGGGCGAAGT GGCGAAGCGG CTGGCACACG AAATCCGCAA
     TCCGCTCACG

1501 CCCATCCAGC TTTCCGCCGA ACGGCTGGCG TGGAAATTGG
     GCGGGAAGCT

1551 GGATGAGCAG GATGCGCAAA TCCTGACGCG TTCGACCGAC
     ACCATCGTCA
```

-continued

```
1601 AACAGGTGGC GGCATTGAAG GAAATGGTCG AAGCATTCCG
     CAATTATGCG
1651 CGTTCCCCTT CGCTCAAATT GGAAAATCAG GATTTGAACG
     CCTTAATCGG
1701 CGATGTGTTG GCATTGTATG AAGCCGGTCC GTGCCGGTTT
     GCGGCGGAGC
1751 TTGCCGGCGA ACCGCTGACG GTGGCGGCGG ATACGACCGC
     CATGCGGCAG
1801 GTGCTGCACA ATATTTTCAA AAATGCCGCC GAAGCGGCGG
     AAGAAGCCGA
1851 TGTGCCCGAA GTCAGGGTAA AATCGGAAAC AGGGCAGGAC
     GGTCGGATTG
1901 TCCTGACGGT TTGCGACAAC GGCAAAGGGT TCGGCAGGGA
     AATGCTGCAC
1951 AACGCCTTCG AGCCGTATGT AACGGACAAA CCGGCGGGAA
     CGGGATTGGG
2001 TCTGCCTGTG GTGAAAAAAA TCATTGAAGA ACACGGCGGC
     CGCATCAGCC
2051 TGAGCAATCA GGATGCGGGT GGCGCGTGTG TCAGAATCAT
     CTTGCCAAAA
2101 ACGGTAAAAA CTTATGCGTA G
```

This corresponds to the amino acid sequence <SEQ ID 252; ORF64-1>:

```
  1 MRRFLPIAAI CAVVLLYGLT AATGSTSSLA DYFWWIVAFS
    AMLLLVLSAV
 51 LARYVILLLK DRRDGVFGSQ IAKRLSGMFT LVAVLPGVFL
    FGVSAQFING
101 TINSWFGNDT HEALERSLNL SKSALNLAAD NALGNAVPVQ
    IDLIGAASLP
151 GDMGRVLEHY AGSGFAQLAL YNAASGKIEK SINPHKLDQP
    FPGKARWEKI
201 QRAGSVRDLE SIGGVLYAQG WLSAGTHNGR DYALFWRQPV
    PKGVAEDAVL
251 IEKARAKYAE LSYSKKGLQT FFLATLLIAS LLSIFLALVM
    ALYFARRFVE
301 PVLSLAEGAK AVAQGDFSQT RPVLRNDEFG RLTKLFNHMT
    EQLSIAKEAD
351 ERNRRREEAA RHYLECVLEG LTTGVVVFDE QGCLKTFNKA
    AEQILGMPLT
401 PLWGSSRHGW HGVSAQQSLL AEVFAAIGAA AGTDKPVHVK
    YAAPDDAKIL
451 LGKATVLPED NGNGVVMVID DITVLIHAQK EAAWGEVAKR
    LAHEIRNPLT
501 PIQLSAERLA WKLGGKLDEQ DAQILTRSTD TIVKQVAALK
    EMVEAFRNYA
551 RSPSLKLENQ DLNALIGDVL ALYEAGPCRF AAELAGEPLT
    VAADTTAMRQ
601 VLHNIFKNAA EAAEEADVPE VRVKSETGQD GRIVLTVCDN
    GKGFGREMLH
651 NAFEPYVTDK PAGTGLGLPV VKKIIEEHGG RISLSNQDAG
    GACVRIILPK
701 TVKTYA*
```

Computer analysis of this amino acid sequence gave the following results:

Homology with a Predicted ORF from *N. meningitidis* (Strain A)

ORF64 shows 92.6% identity over a 392aa overlap with an ORF (ORF64a) from strain A of *N. meningitidis*:

```
                    10         20         30         40         50         60
orf64.pep   MRRFLPIAAICAXXLXXGLTAATGSTSSLADYFWWIVAFSAMLLLVLSAVLARYVILLLK
            ||||||||||||  |  |||||||||||||||||||||||||||||||||||||||||||
orf64a      MRRFLPIAAICAVVLLYGLTAATGSTSSLADYFWWIVAFSAMLLLVLSAVLARYVILLLK
                    10         20         30         40         50         60

70         80         90        100        110        120
orf64.pep   DRRDGVFGSXXAKXPXXXMFTLVAXLPGVFLEGFPAQFINGTINSWFGNDTHEALERSLN
            |||||||||  |||  |  ||||| |||||| |  |||||||||||||||||||||||||
orf64a      DRRDGVFGSQIAKR-LSGMFTLVAXLPGVFLFGVSAQFINGTINSWFGNDTHEALERSLN
                    70         80         90        100        110

130        140        150        160        170        180
orf64.pep   LSKSALNLAADNALGNAVPVQIDLIGAASLPGDMGRVLEHYAGSGFAQLALYNXASGKIE
            ||||||||||||||||| |||| | ||||| ||||||||||||||||||||||:|||||
orf64a      LSKSALNLAADNALGNAIPVQIDXIGAASLPXDMGRVLEHYAGSGFAQLALYNAASGKIE
                   120        130        140        150        160        170

190        200        210        220        230        240
orf64.pep   KSINPHKLDQPFPGKARWEKIQRAGSVRDLESIGGVLYAQGWLSAGTHXGRDYALFFRQP
            |||||||||||||||||||||::|||||| ||||||||| |||| |||  |||||||||
orf64a      KSINPHKLDQPFPGKARWEKIQQAGSVRDXESIGGVLYAXGWLSAXTHNGRDYALFFRQP
                   180        190        200        210        220        230

250        260        270        280        290        300
orf64.pep   VPKGVAEDAVLIEKARAKYAELSYSKKGLQTFFLATLLIASLLSIFLALVMALYFARRFV
            |||||||||||||||||    |||||||||||||||||||||||||||||||||||||||
orf64a      VPKGVAEDAVLIEKARAXXXXLSYSKKGLQTFFLATLLIASLLSIFLALVMALYFARRFV
                   240        250        260        270        280        290

310        320        330        340        350        360
orf64.pep   EPVLSLAEGAKAVAQGDFSQTRPVLRNDEFGRLTXLFNHMTEQLSIAKDADERNRRREEA
            ||||||||||||||||||||||||||||||||||:|||||||||||||:|||||||||||
orf64a      EPVLSLAEGAKAVAQGDFSQTRPVLRNDEFGRLTKLFNHMTEQLSIAKEADERNRRREEA
                   300        310        320        330        340        350
```

```
          370        380        390
orf64.pep ARHYLECVLEGLTTGVVVFDEQGCLKTFNKAAGT
          |||||||||||||||||||||||||||||||||
orf64a    ARHYLECVLEGLTTGVVVFDEQGCLKTFNKAAEQILGMPLTPLWGSSRHGWHGVSAQQSL
          360        370        380        390        400        410
orf64a    LAEVFAAIGAAAGTDKPVHVKYAAPDDAKILLGKATVLPEDNXNGVVMVIDDITVLIHAQ
          420        430        440        450        460        470
```

The complete length ORF64a nucleotide sequence <SEQ ID 253> is:

```
   1 ATGCGCCGTT TTCTACCGAT CGCAGCCATA TGCGCCGTCG
     TCCTGTTGTA
  51 CGGACTGACG GCGGCAACCG GCAGCACCAG TTCGCTGGCG
     GATTATTTCT
 101 GGTGGATTGT TGCGTTCAGC GCAATGCTGC TGCTGGTGTT
     GTCCGCCGTT
 151 TTGGCACGTT ATGTCATATT GCTGTTGAAA GACAGGCGCG
     ACGGCGTATT
 201 CGGTTCGCAG ATTGCCAAAC GCCTTTCCGG GATGTTTACG
     CTGGTTGCCG
 251 TACTGCCCGG CGTGTTTCTG TTCGGCGTTT CCGCACAGTT
     TATCAACGGC
 301 ACGATTAATT CGTGGTTCGG CAACGATACC CACGAGGCGC
     TTGAACGCAG
 351 CCTCAATTTG AGCAAGTCCG CATTGAATCT GGCGGCAGAC
     AACGCCCTTG
 401 GCAACGCCAT CCCCGTGCAG ATAGACNTCA TCGGCGCGGC
     TTCCCTGCCC
 451 NGGGATATGG GCAGGGTGCT GGAACATTAC GCCGGCAGCG
     GTTTTGCCCA
 501 GCTTGCCCTG TACAATGCCG CAAGCGGCAA AATCGAAAAA
     AGCATCAACC
 551 CGCACAAGCT CGATCAGCCG TTTCCAGGTA AGGCGCGTTG
     GGAAAAAATC
 601 CAACAGGCGG GTTCGGTCAG GGATNNGGAA AGCATAGGCG
     GCGTATTGTA
 651 CGCGCANGGC TGGCTGTCGG CAGNNACGCA CAACGGGCGC
     GATTACGCCT
 701 TGTTTTTCCG TCAGCCGGTT CCCAAAGGCG TGGCAGAGGA
     TGCCGTCTTA
 751 ATCGAAAAGG CAAGGGCGNA ANANNNTNAG TTGAGTTACA
     GCAAAAAAGG
 801 TTTGCAGACC TTTTTCCTNG CAACCCTGCT GATTGCCTCN
     CTGCTGTCGA
 851 TTTTTCTTGC ACTGGTCATG GCACTGTATT TCGCCCGCCG
     TTTCGTCGAA
 901 CCCGTCCTAT CGCTTGCCGA GGGGGCGAAG GCGGTGGCGC
     AAGGCGATTT
 951 CAGCCAGACG CGCCCCGTGT TGCGCAACGA CGAGTTCGGA
     CGCTTGACCA
1001 AGTTGTTCAA CCACATGACC GAGCAGCTTT CCATCGCCAA
     AGAAGCAGAC
1051 GAGCGCAACC GCCGGCGCGA GGAAGCCGCC AGACATTATC
     TCGAATGCGT
1101 GTTGGAGGGG CTGACCACGG GCGTGGTGGT GTTTGACGAA
     CAAGGCTGTC
1151 TGAAAACCTT CAACAAAGCG GCGGAACAGA TTTTGGGGAT
     GCCGCTTACC
1201 CCCCTGTGGG GCAGCAGCCG GCACGGTTGG CACGGCGTTT
     CGGCGCAGCA
1251 GTCCCTGCTT GCCGAAGTGT TTGCCGCCAT CGGCGCGGCG
     GCAGGTACGG
1301 ACAAACCGGT CCATGTGAAA TATGCCGCGC CGGACGATGC
     CAAAATCCTG
1351 CTGGGCAAGG CAACCGTCCT GCCCGAAGAC AACNGCAACG
     GCGTGGTAAT
1401 GGTGATTGAC GACATCACCG TTTTGATACA CGCGCAAAAA
     GAAGCCGCGT
1451 GGGGCGAAGT GGCAAACGG CTGGCACACG AAATCCGCAA
     TCCGCTCACG
1501 CCCATCCAGC TTTCTGCCGA ACGGCTGGCG TGGAAATTGG
     GCGGGAAGCT
1551 GGACGAGCAN GACGCGCAAA TCCTGACACG TTCGACCGAC
     ACCATCATCA
1601 AACAAGTGGC GGCATTAAAA GAAATGGTCG AGGCATTCCG
     CAATTACNCG
1651 CGTTCCCCTT CGNCTCAATT GGAAAATCAG GATTTGAACG
     CCTTAATCGG
1701 CGATGTGTTG GCATTGTACG AAGCTGGTCC GTGCCGGTTT
     GCGGCGGAAC
1751 TTGCCGGCGA ACCGCTGATG ATGGCGGCGG ATACGACCGC
     CATGCGGCAG
1801 GTGCTGCACA ATATTTTCAA AAATGCCGCC GAAGCGGCGG
     AAGAAGCCGA
1851 TGTGCCCGAA GTCAGGGTAA AATCGGAAGC GGGGCAGGAC
     GCACGGATTG
1901 TCCTGACAGT TTGCGACAAC GGCAAGGGGT TCGGCAGGGA
     AATGCTGCAC
1951 AATGCCTTCG AGCCGTATGT AACGGACAAA CCGGCTGGAA
     CGGGATTGNG
2001 ACTGCCCGTG GTGAAAAAAA TCATTGAAGA ACACGGCGGC
     CNCATCAGCC
2051 TGAGCAATCA GGATGCGGGC GGCGCGTNTG TCAGAATCAT
     CTTGCCAAAA
2101 ACGGTAGAAA CTTATGCGTA G
```

This encodes a protein having amino acid sequence <SEQ ID 254>:

```
  1 MRRFLPIAAI CAVVLLYGLT AATGSTSSLA DYFWWIVAFS
    AMLLLVLSAV

51 LARYVILLLK DRRDGVFGSQ IAKRLSGMFT LVAVLPGVFL
    FGVSAQFING

101 TINSWFGNDT HEALERSLNL SKSALNLAAD NALGNAIPVQ
    IDXIGAASLP

151 XDMGRVLEHY AGSGFAQLAL YNAASGKIEK SINPHKLDQP
    FPGKARWEKI

201 QQAGSVRDXE SIGGVLYAXG WLSAXTHNGR DYALFFRQPV
    PKGVAEDAVL

251 IEKARAXXXX LSYSKKGLQT FFLATLLIAS LLSIFLALVM
    ALYFARRFVE

301 PVLSLAEGAK AVAQGDFSQT RPVLRNDEFG RLTKLFNHMT
    EQLSIAKEAD

351 ERNRRREEAA RHYLECVLEG LTTGVVVFDE QGCLKTFNKA
    AEQILGMPLT
```

```
                                       -continued
401 PLWGSSRHGW HGVSAQQSLL AEVFAAIGAA AGTDKPVHVK
    YAAPDDAKIL

451 LGKATVLPED NXNGVVMVID DITVLIHAQK EAAWGEVAKR
    LAHEIRNPLT

501 PIQLSAERLA WKLGGKLDEX DAQILTRSTD TIIKQVAALK
    EMVEAFRNYX

551 RSPSXQLENQ DLNALIGDVL ALYEAGPCRF AAELAGEPLM
    MAADTTAMRQ

601 VLHNIFKNAA EAAEEADVPE VRVKSEAGQD GRIVLTVCDN
    GKGFGREMLH

651 NAFEPYVTDK PAGTGLXLPV VKKIIEEHGG XISLSNQDAG
    GAXVRIILPK

701 TVETYA*
```

ORF64a and ORF64-1 show 96.6% identity in 706 aa overlap:

```
                    10         20         30         40         50         60
orf64a.pep  MRRFLPIAAICAVVLLYGLTAATGSTSSLADYFWWIVAFSAMLLLVLSAVLARYVILLLK
            ||||||||||||||||||||||||||||||||||||||||||||||||||||||||||||
orf64-1     MRRFLPIAAICAVVLLYGLTAATGSTSSLADYFWWIVAFSAMLLLVLSAVLARYVILLLK
                    10         20         30         40         50         60

70         80         90        100        110        120
orf64a.pep  DRRDGVFGSQIAKRLSGMFTLVAVLPGVFLFGVSAQFINGTINSWFGNDTHEALERSLNL
            ||||||||||||||||||||||||||||||||||||||||||||||||||||||||||||
orf64-1     DRRDGVFGSQIAKRLSGMFTLVAVLPGVFLFGVSAQFINGTINSWFGNDTHEALERSLNL
                    70         80         90        100        110        120

130        140        150        160        170        180
orf64a.pep  SKSALNLAADNALGNAIPVQIDXIGAASLPXDMGRVLEHYAGSGFAQLALYNAASGKIEK
            |||||||||||||||||||:|||:||||||:|||||||||||||||||||||||||||||
orf64-1     SKSALNLAADNALGNAVPVQIDLIGAASLPGDMGRVLEHYAGSGFAQLALYNAASGKIEK
                   130        140        150        160        170        180

190        200        210        220        230        240
orf64a.pep  SINPHKLDQPFPGKARWEKIQQAGSVRDXESIGGVLYAXGWLSAXTHNGRDYALFFRQPV
            |||||||||||||||||||||:||||||:||||||||:|||||:||||||||||||||||
orf64-1     SINPHKLDQPFPGKARWEKIQRAGSVRDLESIGGVLYAQGWLSAGTHNGRDYALFFRQPV
                   190        200        210        220        230        240

250        260        270        280        290        300
orf64a.pep  PKGVAEDAVLIEKARAXXXXLSYSKKGLQTFFLATLLIASLLSIFLALVMALYFARRFVE
            |||||||||||||||||    ||||||||||||||||||||||||||||||||||||||
orf64-1     PKGVAEDAVLIEKARAKYAELSYSKKGLQTFFLATLLIASLLSIFLALVMALYFARRFVE
                   250        260        270        280        290        300

310        320        330        340        350        360
orf64a.pep  PVLSLAEGAKAVAQGDFSQTRPVLRNDEFGRLTKLFNHMTEQLSIAKEADERNRRREEAA
            ||||||||||||||||||||||||||||||||||||||||||||||||||||||||||||
orf64-1     PVLSLAEGAKAVAQGDFSQTRPVLRNDEFGRLTKLFNHMTEQLSIAKEADERNRRREEAA
                   310        320        330        340        350        360

370        380        390        400        410        420
orf64a.pep  RHYLECVLEGLTTGVVVFDEQGCLKTFNKAAEQILGMPLTPLWGSSRHGWHGVSAQQSLL
            ||||||||||||||||||||||||||||||||||||||||||||||||||||||||||||
orf64-1     RHYLECVLEGLTTGVVVFDEQGCLKTFNKAAEQILGMPLTPLWGSSRHGWHGVSAQQSLL
                   370        380        390        400        410        420

430        440        450        460        470        480
orf64a.pep  AEVFAAIGAAAGTDKPVHVKYAAPDDAKILLGKATVLPEDNXNGVVMVIDDITVLIHAQK
            |||||||||||||||||||||||||||||||||||||||||| |||||||||||||||||
orf64-1     AEVFAAIGAAAGTDKPVHVKYAAPDDAKILLGKATVLPEDNGNGVVMVIDDITVLIHAQK
                   430        440        450        460        470        480

490        500        510        520        530        540
orf64a.pep  EAAWGEVAKRLAHEIRNPLTPIQLSAERLAWKLGGKLDEXDAQILTRSTDTIIKQVAALK
            |||||||||||||||||||||||||||||||||||||||:|||||||||||:||||||||
orf64-1     EAAWGEVAKRLAHEIRNPLTPIQLSAERLAWKLGGKLDEQDAQILTRSTDTIVKQVAALK
                   490        500        510        520        530        540

550        560        570        580        590        600
orf64a.pep  EMVEAFRNYXRSPSXQLENQDLNALIGDVLALYEAGPCRFAAELAGEPLMMAADTTAMRQ
            ||||||||| |||| |||||||||||||||||||||||||||||||||: ||||||||||
orf64-1     EMVEAFRNYARSPSLKLENQDLNALIGDVLALYEAGPCRFAAELAGEPLTVAADTTAMRQ
                   550        560        570        580        590        600
```

```
                 610        620        630        640        650        660
orf64a.pep  VLHNIFKNAAEAAEEADVPEVRVKSEAGQDGRIVLTVCDNGKGFGREMLHNAFEPYVTDK
            ||||||||||||||||||||||||||:|||||||||||||||||||||||||||||||||
orf64-1     VLHNIFKNAAEAAEEADVPEVRVKSETGQDGRIVLTVCDNGKGFGREMLHNAFEPYVTDK
                 610        620        630        640        650        660
                 670        680        690        700
orf64a.pep  PAGTGLXLPVVKKIIEEHGGXISLSNQDAGGAXVRIILPKTVETYAX
            ||||||:|||||||||||||:|||||||||||:|||||||||:|||:
orf64-1     PAGTGLGLPVVKKIIEEHGGRISLSNQDAGGACVRIILPKTVKTYAX
                 670        680        690        700
```

Homology with a Predicted ORF from *N. gonorrhoeae*
ORF64 shows 86.6% identity over a 387aa overlap with a predicted ORF (ORF64.ng) from *N. gonorrhoeae*:

```
orf64.pep  MRRFLPIAAICAXXLXXGLTAATGSTSSLADYFWWIVAFSAMLLLVLSAVLARYVILLLK   60
           |||||||||||    |  ||||||||||||||||||||:|||||||||||||||||||||
orf64ng    MRRFLPIAAICAVVLLYGLTAATGSTSSLADYFWWIVSFSAMLLLVLSAVLARYVILLLK   60
orf64.pep  DRRDGVFGSXXAKXPXXXMFTLVAXLPGVFLFGFPAQFINGTINSWFGNDTHEALERSLN  120
           |||:||||| ||  |   ||||||:|||:|||| ||:|||||||||||||||||||||||
orf64ng    DRRNGVFGSQIAKR-LSGMFTLVAVLPGLFLFGISAQFINGTINSWFGNDTHEALERSLN  119
orf64.pep  LSKSALNLAADNALGNAVPVQIDLIGAASLPGDMGRVLEHYAGSGFAQLALYNXASGKIE  180
           ||||||:||||| :|||||||||||||:||| ||:|||||||||||||||||||:|||||
orf64ng    LSKSALDLAADNAVSNAVPVQIDLIGTASLSGNMGSVLEHYAGSGFAQLALYNAASGKIE  179
orf64.pep  KSINPHKLDQPFPGKARWEKIQRAGSVRDLESIGGVLYAQGWLSAGTHXGRDYALFFRQP  240
           ||||||::||| |||:  ||:| ::|:|::|||||||||||||||||| ||||||||||
orf64ng    KSINPHQFDQPLPDKEHWEQIQQTGSVRSLESIGGVLYAQGWLSAGTHNGRDYALFFRQP  239
orf64.pep  VPKGVAEDAVLIEKARAKYAELSYSKKGLQTFFLATLLIASLLSIFLALVMALYFARRPV  300
           :|::||:|||||||||||||||||||||||||||:||||||||||||||||||||||||
orf64ng    IPENVAQDAVLIEKARAKYAELSYSKKGLQTFFLVTLLIASLLSIFLALVMALYFARRPV  299
orf64.pep  EPVLSLAEGAKAVAQGDFSQTRPVLRNDEFGRLTXLFNHMTEQLSIAKDADERNRRREEA  360
           ||:||||||||||||||||||||||||||||||| ||||||||||||:||||||||||||
orf64ng    EPILSLAEGAKAVAQGDFSQTRPVLRNDEFGRLTKLFNHMTEQLSIAKEADERNRRREEA  359
orf64.pep  ARHYLECVLEGLTTGVVVFDEQGCLKTFNKAAGT                           394
           ||||||||:|||||||||  :    :|:|
orf64ng    ARHYLECVLDGLTTGVVVSYPLSCCRTAVFSTCHSSPLSYF                    400
```

An ORF64ng nucleotide sequence <SEQ ID 255> was predicted to encode a protein having amino acid sequence <SEQ ID 256>:

```
  1 MRRFLPIAAI CAVVLLYGLT AATGSTSSLA DYFWWIVSFS
    AMLLLVLSAV

51 LARYVILLLK DRRNGVFGSQ IAKRLSGMFT LVAVLPGLFL
    FGISAQFING

101 TINSWFGNDT HEALERSLNL SKSALDLAAD NAVSNAVPVQ
    IDLIGTASLS

151 GNMGSVLEHY AGSGFAQLAL YNAASGKIEK SINPHQFDQP
    LPDKEHWEQI

201 QQTGSVRSLE SIGGVLYAQG WLSAGTHNGR DYALFFRQPI
    PENVAQDAVL

251 IEKARAKYAE LSYSRKGLQT FFLVTLLIAS LLSIFLALVM
    ALYFARRFVE

301 PILSLAEGAK AVAQGDFSQT RPVLRNDEFG RLTKLFNHMT
    EQLSIAKEAD

351 ERNRRREEAA RHYLECVLDG LTTGVVVSYP LSCCRTAVFS
    TCHSSPLSYF*
```

Further work revealed the complete gonococcal DNA sequence <SEQ ID 257>:

```
  1 ATGCGCCGCT TCCTACCGAT CGCAGCCATA TGCGCCGTCG
    TCCTGCTGTA

51 CGGATTGACG GCGGCGACCG GCAGCACCAG TTCGCTGGCG
    GATTATTTCT

101 GGTGGATAGT CTCGTTCAGC GCAATGCTGC TGCTGGTGTT
    GTCCGCCGTT

151 TTGGCACGTT ATGTCATATT GCTGTTGAAA GACAGGCGCA
    ACGGCGTGTT

201 CGGTTCGCAG ATTGCCAAAC GCCTTTCCGG GATGTTCACG
    CTGGTCGCCG

251 TACTGCCCGG CTTGTTCCTG TTCGGCATTT CCGCGCAGTT
    TATCAACGGC

301 ACGATTAATT CGTGGTTCGG CAACGACACC CACGAAGCCC
    TCGAACGCAG

351 CCTTAATTTG AGCAAGTCCG CACTGGATTT GGCGGCAGAC
    AATGCCGTCA

401 GCAACGCCGT TCCCGTACAG ATAGACCTCA TCGGCACCGC
    CTCCCTGTCG

451 GGCAATATGG GCAGTCTGCT GGAACACTAC GCCGGCAGCG
    GTTTTGCCCA

501 GCTTGCCCTG TACAATGCCG CAAGCGGGAA AATCGAAAAA
    AGCATCAATC
```

-continued

```
 551 CGCACCAATT CGACCAGCCG CTTCCCGACA AAGAACATTG
     GGAACAGATT

601 CAGCAGACCG GTTCGGTTCG CAGTTTGGAA AGCATAGGCG
     GCGTATTGTA

651 CGCGCAGGGA TGGTTGTCGG CAGGTACGCA CAACGGGCGC
     GATTACGCGC

701 TGTTCTTCCG CCAGCCGATT CCCGAAAATG TGGCACAGGA
     TGCCGTTCTG

751 ATTGAAAAGG CGCGGGCGAA ATATGCCGAA TTGAGTTACA
     GCAAAAAGG

801 TTTGCAGACC TTTTTTCTGG TAACCCTGCT GATTGCCTCG
     CTGCTGTCGA

851 TTTTTCTTGC GCTGGTAATG GCACTGTATT TTGCCCGCCG
     TTTCGTCGAA

901 CCCATTCTGT CGCTTGCCGA GGGCGCAAAG GCGGTGGCGC
     AGGGTGATTT

951 CAGCCAGACG CGCCCCGTAT TGCGCAACGA CGAGTTCGGA
     CGTTTGACCA

1001 AGCTGTTCAA CCATATGACC GACCAGCTTT CCATCGCCAA
     AGAAGCAGAC

1051 GAACGCAACC GCCGGCGCGA GGAAGCCGCC CGTCACTACC
     TCGAGTGCGT

1101 GTTGGATGGG TTGACTACCG GTGTGGTGGT GTTTGACGAA
     AAAGGCCGTT

1151 TGAAAACCTT CAACAAGGCG GCGGAACAGA TTTTGGGGAT
     GCCGCTCGCC

1201 CCCCTGTGGG GCAGCAGCCG GCACGGTTGG CACGGCGTTT
     CGGCGCAGCA

1251 GTCCCTGCTT GCCGAAGTGT TtgccgccAT CGGTGCGGCG
     GCAGGTACGG

1301 ACAAACCGGT CCAGGTGGAA TATGCCGCGC CGGACGATGC
     CAAAATCCTG

1351 CTGGGCAAGG CGACGGTATT GCCCGAAGAC AACGGCAACG
     GCGTGGTGAT

1401 CGTGATTGAC GACATCACCG TGCTGATACG CGCGCAAAAA
     GAAGCCGCGT

1451 GGGGTGAAGT GGCGAACCGG CTGGCACACG AAATCCGCAA
     TCCGCTCACG

1501 CCCATCCAGC TTTCCGCCGA ACGGCTGGCG TGGAAATTGG
     GCGGGAAGCT

1551 GGACGATCAG GACGCGCAAA TCCTGACGCG TtcgACCGAC
     ACCATCATCA

1601 AACAGgtggc gGCGTTAAAA GAAATGGTCG AGGCATTCCG
     CAATTACGCG

1651 CGCGCCCCTT CGCTCAAACT GGAAAATCAG GATTTGAACG
     CCTTAATCGG

1701 CGATGTTTTG GCCCTGTACG AAGCCGGCCC GTGCCGGTTT
     GAGGCGGAAC

1751 TTGCCGGCGA ACCGCTGATG ATGGCGGCGG ATACGACCGC
     CATGCGGCAG

1801 GTGCTGCACA ATATTTTCAA AAATGCCGCC GAAGCGGCGG
     AAGAGCCGA

1851 TATGCCCGAA GTCAGGGTAA AATCGGAAAC GGGGCAGGAC
     GGACGGATTG

1901 TCCTGACGGT TTGCGACAAC GGCAAGGGAT TCGGCAAGGA
     AATGCTGCAC

1951 AATGCTTTCG AGCCGTATGT GACGGATAAG CCCGCGGGAA
     CGGGACTGGG

2001 TCTGCCTGTA GTGAAAAAAA TCATTGGAGA ACACGGCGGC
     CGCATCAGCC

2051 TGAGCAATCA GGATGCGGGT GGGGCGTGTG TCAGAATCAT
     CTTGCCAAAA

2101 ACGGTAGAAA CTTATGCGTA G
```

This corresponds to the amino acid sequence <SEQ ID 258; ORF64ng-1>:

```
  1 MRRFLPIAAI CAVVLLYGLT AATGSTSSLA DYFWWIVSFS
    AMLLLVLSAV

51 LARYVILLLK DRRNGVFGSQ IAKRLSGMFT LVAVLPGLFL
    FGISAQFING

101 TINSWFGNDT HEALERSLNL SKSALDLAAD NAVSNAVPVQ
    IDLIGTASLS

151 GNMGSVLEHY AGSGFAQLAL YNAASGKIEK SINPHQFDQP
    LPDKEHWEQI

201 QQTGSVRSLE SIGGVLYAQG WLSAGTHNGR DYALFFRQPI
    PENVAQDAVL

251 IEKARAKYAE LSYSKKGLQT FFLVTLLIAS LLSIFLALVM
    ALYFARRFVE

301 PILSLAEGAK AVAQGDFSQT RPVLRNDEFG RLTKLFNHMT
    EQLSIAKEAD

351 ERNRRREEAA RHYLECVLDG LTTGVVVFDE KGRLKTFNKA
    AEQILGMPLA

401 PLWGSSRHGW HGVSAQQSLL AEVFAAIGAA AGTDKPVQVE
    YAAPDDAKIL

451 LGKATVLPED NGNGVVMVID DITVLIRAQK EAAWGEVAKR
    LAHEIRNPLT

501 PIQLSAERLA WKLGGKLDDQ DAQILTRSTD TIIKQVAALK
    EMVEAFRNYA

551 RAPSLKLENQ DLNALIGDVL ALYEAGPCRF EAELAGEPLM
    MAADTTAMRQ

601 VLHNIFKNAA EAAEEADMPE VRVKSETGQD GRIVLTVCDN
    GKGFGKEMLH

651 NAFEPYVTDK PAGTGLGLPV VKKIIGEHGG RISLSNQDAG
    GACVRIILPK

701 TVETYA*
```

ORF64ng-1 and ORF64-1 show 93.8% identity in 706 aa overlap:

```
              10        20        30        40        50        60
orf64ng-1.pep MRRFLPIAAICAVVLLYGLTAATGSTSSLADYFWWIVSFSAMLLLVLSAVLARYVILLLK
              ||||||||||||||||||||||||||||||||||:|||||||||||||||||||||||||
orf64-1       MRRFLPIAAICAVVLLYGLTAATGSTSSLADYFWWIVAFSAMLLLVLSAVLARYVILLLK
              10        20        30        40        50        60
              70        80        90       100       110       120
orf64ng-1.pep DRRNGVFGSQIAKRLSGMFTLVAVLPGLFLFGISAQFINGTINSWFGNDTHEALERSLNL
              |||:|||||||||||||||||||||||:||||:|||||||||||||||||||||||||||
orf64-1       DRRDGVFGSQIAKRLSGMFTLVAVLPGVFLFGVSAQFINGTINSWFGNDTHEALERSLNL
              70        80        90       100       110       120
              130       140       150       160       170       180
orf64ng-1.pep SKSALDLAADNAVSNAVPVQIDLIGTASLSGNMGSVLEHYAGSGFAQLALYNAASGKIEK
              |||||:||||||::|||||||||||:|||:|||  |:||||||||||||||||||||||
orf64-1       SKSALNLAADNALGNAVPVQIDLIGAASLPGDMGRVLEHYAGSGFAQLALYNAASGKIEK
              130       140       150       160       170       180
              190       200       210       220       230       240
orf64ng-1.pep SINPHQFDQPLPDKEHWEQIQQTGSVRSLESIGGVLYAQGWLSAGTHNGRDYALFFRQPI
              |||||::|:||| :|:|::|:|:|||:||||||||||||||||||||||||||||||||:
orf64-1       SINPHKLDQPFPGKARWEKIQRAGSVRDLESIGGVLYAQGWLSAGTHNGRDYALFFRQPV
              190       200       210       220       230       240
              250       260       270       280       290       300
orf64ng-1.pep PENVAQDAVLIEKARAKYAELSYSKKGLQTFFLVTLLIASLLSIFLALVMALYFARRFVE
              |::||:||||||||||||||||||||||||||||:|||||||||:|||||||||||||||
orf64-1       PKGVAEDAVLIEKARAKYAELSYSKKGLQTFFLATLLIASLLSIPLALVMALYFARRFVE
              250       260       270       280       290       300
              310       320       330       340       350       360
orf64ng-1.pep PILSLAEGAKAVAQGDFSQTRPVLRNDEFGRLTKLFNHMTEQLSIAKEADERNRREEAA
              |:||||||||||||||||||||||||||||||||||||||||||||||||||||||||
orf64-1       PVLSLAEGAKAVAQGDFSQTRPVLRNDEFGRLTKLFNHMTEQLSIAKEADERNRREEAA
              310       320       330       340       350       360
              370       380       390       400       410       420
orf64ng-1.pep RHYLECVLDGLTTGVVVFDEKGRLKTFNKAAEQILGMPLAPLWGSSRHGWHGVSAQQSLL
              ||||||||:||||||||||:|| ||||||||||||||||:||||||||||||||||||||
orf64-1       RHYLECVLEGLTTGVVVFDEQGCLKTFNKAAEQILGMPLTPLWGSSRHGWHGVSAQQSLL
              370       380       390       400       410       420
              430       440       450       460       470       480
orf64ng-1.pep AEVFAAIGAAAGTDKPVQVEYAAPDDAKILLGKATVLPEDNGNGVVMVIDDITVLIRAQK
              |||||||||||||||||:|:|||||||||||||||||||||||||||||||||||||:|
orf64-1       AEVFAAIGAAAGTDKPVHVKYAAPDDAKILLGKATVLPEDNGNGVVMVIDDITVLIHAQK
              430       440       450       460       470       480
              490       500       510       520       530       540
orf64ng-1.pep EAAWGEVAKRLAHEIRNPLTPIQLSAERLAWKLGGKLDDQDAQILTRSTDTIIKQVAALK
              ||||||||||||||||||||||||||||||||||||| :||||||||||||| ||||||
orf64-1       EAAWGEVAKRLAHEIRNPLTPIQLSAERLAWKLGGKLDEQDAQILTRSTDTIVKQVAALK
              490       500       510       520       530       540
              550       560       570       580       590       600
orf64ng-1.pep EMVEAFRNYARAPSLKLENQDLNALIGDVLALYEAGPCRFEAELAGEPLMMAADTTAMRQ
              ||||||||||| ||||||||||||||||||||||||||||| ||||||| ||||||||
orf64-1       EMVEAFRNYARSPSLKLENQDLNALIGDVLALYEAGPCRFAAELAGEPLTVAADTTAMRQ
              550       560       570       580       590       600
              610       620       630       640       650       660
orf64ng-1.pep VLHNIFKNAAEAAEEADMPEVRVKSETGQDGRIVLTVCDNGKGFGKEMLHNAFEPYVTDK
              |||||||||||||||||:||||||||||||||||||||||||||:|||||||||||||
orf64-1       VLHNIFKNAAEAAEEADVPEVRVKSETGQDGRIVLTVCDNGKGFGREMLHNAFEPYVTDK
              610       620       630       640       650       660
              670       680       690       700
orf64ng-1.pep PAGTGLGLPVVKKIIGEHGGRISLSNQDAGGACVRIILPKTVETYAX
              |||||||||||||||:|||||||||||||||||||||||||:||||
orf64-1       PAGTGLGLPVVKKIIEEHGGRISLSNQDAGGACVRIILPKTVKTYAX
              670       680       690       700
```

Furthermore, ORF64ng-1 shows significant homology to a protein from *A. caulinodans*:

```
sp|Q04850|NTRY_AZOCA NITROGEN REGULATION PROTEIN NTRY
>gi|77479|pir||S18624 ntrY protein - Azorhizobium caulinodans >gi|38737
(X63841) NtrY gene product [Azorhizobium caulinodans] Length = 771
Score = 218 bits (550), Expect = 7e-56
Identities = 195/720 (27%), Positives = 320/720 (44%), Gaps = 58/720 (8%)
Query:   7 IAAICAVVLLYGLTAATGSTSSLADYFWWIXXXXXXXXXXXXXXXXXXRYVILLLKDRRNGV   66
           I+A+  ++L GLT    +     +     +           R+  +KR  G
Sbjct:  35 ISALATFLILMGLTPVVPTHQVVIS----VLLVNAAAVLILSAMVGREIWRIAKARARGR   90

Query:  67 FGSQIAKRLSGMFTLVAVLPGLFLFGISAQFINGTINSWFGNDTHEALERSLNLSKSALD  126
           +++  R+ G+F +V+V+P + + +++ ++ WF    T E   S++++++ +
Sbjct:  91 AAARLHIRIVGLFAVVSVVPAILVAVVASLTLDRGLDRWFSMRTQEIVASSVSVAQTYVR  150

Query: 127 LAADNAVSNAVPVQIDLIGTASLSGNMGSVLEHYAG--SGFAQLALYNAASGKIEKSINP  184
            A N   +++ DL  S+         YG  SF Q+    AA +  ++
```

-continued

```
Sbjct: 151 EHALNIRGDILAMSADLTRLKSV----------YEGDRSRFNQILTAQAALRNLPGAMLI 200

Query: 185 HQFDQPLPDKEHWEQIQQTGSVRSLESIGGVLYAQGWLSAGTHNGRDYA----------- 233
            + D  + ++ +   I +   V +  +IG     Q  +     N  DY
Sbjct: 201 RR-DLSVVERAN-VNIGREFIVPANLAIGDATPDQPVIYLP--NDADYVAAVVPLKDYDD 256

Query: 234 --LFFRQPIPENVAQDAVLIEKARAKYAELSYSKKGLQTFFLVTXXXXXXXXXXXXXVMA 291
              L+  + I   V       ++  A Y  L   + G+Q  F +               +
Sbjct: 257 LYLYVARLIDPRVIGYLKTTQETLADYRSLEERRFGVQVAFALMYAVITLIVLLSAVWLG 316

Query: 292 LYFARRFVEPILSLAEGAKAVAQGDFSQTRPVLRND-EFGRLTKLFNHMTEQLSIXXXXX 350
            L F++  V PI  L   A  VA+G+     P+ R + +   L + FN MT +L
Sbjct: 317 LNFSKWLVAPIRRLMSAADHVAEGNLDVRVPIYRAEGDLASLAETFNKMTHELRSQREAI 376

Query: 351 XXXXXXXXXXXHYLECVLDGLTTGVVVFDEKGRLKTFNKAAEQILGMPLAPLWGSSRHGW 410
                        + E VL G+  GV+  D + R+   N++AE++LG  L+ +    RH
Sbjct: 377 LTARDQIDSRRRFTEAVLSGVGAGVIGLDSQERITILNRSAERLLG--LSEVEALHRHLA 434

Query: 411 HGVSAQQSLLAEVFXXXXXXXXTDKPVQVEYAAPDDAKILLGKATVLPEDNG---NGVVM 467
              V     LL E            + VQ        D + +    V  E +    +G V+
Sbjct: 435 EVVPETAGLLEEA------EHARQRSVQGNITLTRDGRERVFAVRVTTEQSPEAEHGWVV 488

Query: 468 VIDDITVLIRAQKEAAWGEVAKRLAHEIRNPLTPIQLSAERLAWKLGGKLDDQDAQILTR 527
             +DDIT LI AQ+ +AW +VA+R+AHEI+NPLTPIQLSAERL  K G  +  QD +I  +
Sbjct: 489 TLDDITELISAQRTSAWADVARRIAHEIKNPLTPIQLSAERLKRKFGRHV-TQDREIFDQ 547

Query: 528 STDTIIKQVAALKEMVEAFRNYARAPSLKLENQDLNALIGDVLALYEAGPCRFEAELAGE 587
             TDTII+QV  +  MV+ F ++AR P   +++QD++ +I   + L   G      +
Sbjct: 548 CTDTIIRQVGDIGRMVDEFSSFARMPKPVVDSQDMSEIIRQTVFLMRVGHPEVVFDSEVP 607

Query: 588 PLMMAA-DTTAMRQVLHNIFKNXXXXXXXXDMPEVRVK-------SETGQDGRIVLTVCD 639
            P M A  D   + Q L NI KN          P+VR +       +  G+D  +V+ + D
Sbjct: 608 PAMPARFDRRLVSQALTNILKNAAEAIEAVP-PDVRGQGRIRVSANRVGED--LVIDIID 664

Query: 640 NGKGFGKEMLHNAFEPYVTDKPAGTGLGLPVVKKIIGEHGGRISLSNQDAG-GACVRIIL 698
            NG G  +E  +   EPYVT +  GTGLGL +V KI+ EHGG I L++   G GA +R+ L
Sbjct: 665 NGTGLPQESRNRLLEPYVTTREKGTGLGLAIVGKIMEEHGGGIELNDAPEGRGAWIRLTL 724
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 31

The following partial DNA sequence was identified in *N. meningitidis* <SEQ ID 259>:

```
  1 ATGTACGCAT TTACCGCCGC ACAGCAACAG AAGGCACTCT
    TCCGGCTGGT

51 GCTTTTTCAT ATCCTCATCA TCGCCGCCAG CAACTATCTG
    GTGCAGTTCC

101 CTTTCCAAAT TTTCGGCATC CACACCACTT GGGGCGCATT
    TTCCTTTCCC
```

-continued

```
151 TTCATCTTCC TTGCCACCGA CCTGACCGTC CGCATTTTCG
    GTTCTCACTT

201 GGCACGGCGG ATTATCTTTT GGGTGATGTT CCCCGCCCTT
    TTGCTTTCCT

251 ACGTCTTTTC CGTTTTGTTC CACAACGGCA GTTGGACAGG
    CTTGGGCGCG

301 CTGTCCGAAT TCAACACCTT TGTCGGACGC ATCGCCTTAG
    CCAGCTTTGC

351 CGCCTACGCG ATCGGACAAA TCCTTGATAT TTTTGTATTC
    AACAAATTAC

401 GCCGTCTGAA AGCGTGGTGG ATTGCACCGA ACGCATCAAC
    CGTCATCGGG

451 CACGCGTTGG ATACG . . .
```

This corresponds to the amino acid sequence <SEQ ID 260; ORF66>:

```
  1 MYAFTAAQQQ KALFRLVLFH ILIIAASNYL VQFPFQIFGI HTTWGAFSFP

51 FIFLATDLTV RIFGSHLARR IIFWVMFPAL LLSYVFSVLF HNGSWTGLGA

101 LSEFNTFVGR IALASFAAYA IGQILDIFVF NKLRRLKAWW IAPNASTVIG

151 HALDT...
```

Further work revealed the complete nucleotide sequence <SEQ ID 261>:

```
  1 ATGTACGCAT TTACCGCCGC ACAGCAACAG AAGGCACTCT TCCGGCTGGT
 51 GCTTTTTCAT ATCCTCATCA TCGCCGCCAG CAACTATCTG GTGCAGTTCC
101 CTTTCCAAAT TTTCGGCATC CACACCACTT GGGGCGCATT TTCCTTTCCC
151 TTCATCTTCC TTGCCACCGA CCTGACCGTC CGCATTTTCG GTTCTCACTT
201 GGCACGGCGG ATTATCTTTT GGGTGATGTT CCCCGCCCTT TTGCTTTCCT
251 ACGTCTTTTC CGTTTTGTTC CACAACGGCA GTTGGACAGG CTTGGGCGCG
301 CTGTCCGAAT TCAACACCTT TGTCGGACGC ATCGCCTTAG CCAGCTTTGC
351 CGCCTACGCG ATCGGACAAA TCCTTGATAT TTTTGTATTC AACAAATTAC
401 GCCGTCTGAA AGCGTGGTGG ATTGCACCGA CCGCATCAAC CGTCATCGGC
451 AACGCCTTGG ATACGCTGGT ATTTTTCGCC GTTGCCTTCT ACGCAAGCAG
501 CGATGGATTT ATGGCGGCAA ACTGGCAGGG CATCGCTTTT GTCGATTACC
551 TGTTCAAACT TACCGTCTGC ACCCTCTTCT TCCTGCCCGC CTACGGCGTG
601 ATACTGAATC TGCTGACGAA AAAACTGACA ACCCTGCAAA CCAAACAGGC
651 GCAAGACCGC CCCGCGCCCT CGCTGCAAAA TCCGTAA
```

This corresponds to the amino acid sequence <SEQ ID 262; ORF66-1>:

```
  1 MYAFTAAQQQ KALFRLVLFH ILIIAASNYL VQFPFQIFGI HTTWGAFSFP
 51 FIFLATDLTV RIFGSHLARR IIFWVMFPAL LLSYVFSVLF HNGSWTGLGA
101 LSEFNTFVGR IALASFAAYA IGQILDIFVF NKLRRLKAWW IAPTASTVIG
151 NALDTLVFFA VAFYASSDGF MAANWQGIAF VDYLFKLTVC TLFFLPAYGV
201 ILNLLTKKLT TLQTKQAQDR PAPSLQNP*
```

Computer analysis of this amino acid sequence gave the following results:

Homology with the Hypothetical Protein o221 of *E. Coli* (Accession Number P37619)

ORF66 and o221 protein show 67% aa identity in 155aa overlap:

```
orf66    1 MYAFTAAQQQKALFRLVLFHILIIAASNYLVQFPFQIFGIHTTWGAFSFPFIFLATDLTV  60
             M   F+  Q+ KALF L LFH+L+I +SNYLVQ P   I G HTTWGAFSFPFIFLATDLTV
o221     1 MNVFSQTQRYKALFWLSLFHLLVITSSNYLVQLPVSILGFHTTWGAFSFPFIFLATDLTV  60 orf66   61 RIFGSHLARRIIFWVMFPALLLSYVFSVLFHNGSWTGLGALSEFNTFVGRIALASFAAYA 120
           RIFG+ LARRIIF VM PALL+SYV S LF+ GSW G GAL+ FN FV RIA ASF AYA
o221    61 RIFGAPLARRIIFAVMIPALLISYVISSLFYMGSWQGFALAHFNLFVARIATASFMAYA 120 orf66  121 IGQILDIFVFNKLRRLKAWWIAPNASTVIGHALDT                         155
           +GQILD+ VFN+LR+ + WW+AP AST+ G+   DT
o221   121 LGQILDVHVFNRLRQSRRWWLAPTASTLFGNVSDT                         155
```

Homology with a Predicted ORF from *N. meningitidis* (Strain A)

ORF66 shows 96.1% identity over a 155aa overlap with an ORF (ORF66a) from strain A of *N. meningitidis*:

```
              10        20        30        40        50        60
orf66.pep  MYAFTAAQQQKALFRLVLFHILIIAASNYLVQPPFQIFGIHTTWGAFSFPFIFLATDLTV
           ||||||||||||| ||||||||||||||||||||| |||||||||||||||||||||||
orf66a     MYAFTAAQQQKALFWLVLFHILIIAASNYLVQPPFQISGIHTTWGAFSFPFIFLATDLTV
              10        20        30        40        50        60
              70        80        90       100       110       120
orf66.pep  RIFGSHLARRIIFWVMFPALLLSYVFSVLFHNGSWTGLGALSEFNTFVGRIALASFAAYA
           ||||||||||||||||||||||||||||||||||||||||||||||||||||||||||||
orf66a     RIFGSHLARRIIFWVMFPALLLSYVFSVLFHNGSWTGLGALSEFNTFVGRIALASFAAYA
              70        80        90       100       110       120
             130       140       150
orf66.pep  IGQILDIFVFNKLRRLKAWWIAPNASTVIGHALDT
           :||||||||||||||||||||:||:|||||:||||
orf66a     LGQILDIFVFNKLRRLKAWWVAPTASTVIGNALDTLVFFAVAFYASSDGFMAANWQGIAF
             130       140       150       160       170       180
orf66a     VDYLFKLTVCGLFFLPAYGVILNLLTKKLTTLQTKQAQDRPAPSLQNPX
             190       200       210       220
```

The complete length ORF66a nucleotide sequence <SEQ ID 263> is:

```
  1 ATGTACGCAT TTACCGCCGC ACAGCAACAG AAGGCACTCT TCTGGCTGGT

51 GCTTTTTCAT ATCCTCATCA TCGCCGCCAG CAACTATCTG GTGCAGTTCC

101 CCTTCCAAAT TTCCGGCATC CACACCACTT GGGGCGCGTT TTCCTTTCCC

151 TTCATCTTCC TCGCCACCGA CCTGACCGTC CGCATTTTCG GTTCGCACTT

201 GGCACGGCGG ATTATCTTTT GGGTCATGTT CCCCGCCCTT TTGCTTTCCT

251 ACGTCTTTTC CGTTTTGTTC CACAACGGCA GTTGGACGGG CTTGGGCGCG

301 CTGTCCGAAT TCAACACCTT TGTCGGACGC ATCGCGCTGG CAAGTTTTGC

351 CGCCTACGCG CTCGGACAAA TCCTTGATAT TTTTGTGTTC AACAAATTAC

401 GCCGTCTGAA AGCGTGGTGG GTTGCCCCGA CTGCATCAAC CGTCATCGGC

451 AACGCCTTAG ATACGTTGGT ATTTTTCGCC GTTGCCTTCT ACGCAAGCAG

501 CGATGGATTT ATGGCGGCAA ACTGGCAGGG CATCGCTTTT GTCGATTACC

551 TGTTCAAACT CACCGTCTGC GGTCTGTTTT TCCTGCCCGC CTACGGCGTG

601 ATTCTGAATC TGCTGACGAA AAAACTGACG ACCCTGCAAA CCAAACAGGC

651 GCAAGACCGC CCCGCGCCCT CGCTGCAAAA TCCGTAA
```

This encodes a protein having amino acid sequence <SEQ ID 264>:

```
  1 MYAFTAAQQQ KALFWLVLFH ILIIAASNYL VQPPFQISGI HTTWGAFSFP

51 FIFLATDLTV RIFGSHLARR IIFWVMFPAL LLSYVFSVLF HNGSWTGLGA

101 LSEFNTFVGR IALASFAAYA LGQILDIFVF NKLRRLKAWW VAPTASTVIG

151 NALDTLVFFA VAFYASSDGF MAANWQGIAF VDYLFKLTVC GLFFLPAYGV

201 ILNLLTKKLT TLQTKQAQDR PAPSLQNP*
```

ORF66a and ORF66-1 show 97.8% identity in 228 aa overlap:

```
                  10         20         30         40         50         60
orf66a.pep  MYAFTAAQQQKALFWLVLFHILIIAASNYLVQFPFQISGIHTTWGAFSFPFIFLATDLTV
            ||||||||||||| ||||||||||||||||||||||| ||||||||||||||||||||||
orf66-1     MYAFTAAQQQKALFRLVLFHILIIAASNYLVQFPFQIFGIHTTWGAFSFPFIFLATDLTV
                  10         20         30         40         50         60
                  70         80         90        100        110        120
orf66a.pep  RIFGSHLARRIIFWVMFPALLLSYVFSVLFHNGSWTGLGALSEFNTFVGRIALASFAAYA
            ||||||||||||||||||||||||||||||||||||||||||||||||||||||||||||
orf66-1     RIFGSHLARRIIFWVMFPALLLSYVFSVLFHNGSWTGLGALSEFNTFVGRIALASFAAYA
                  70         80         90        100        110        120
                 130        140        150        160        170        180
orf66a.pep  LGQILDIFVFNKLRRLKAWWVAPTASTVIGNALDTLVFFAVAFYASSDGFMAANWQGIAF
            :|||||||||||||||||||:|||||||||||||||||||||||||||||||||||||||
orf66-1     IGQILDIFVFNKLRRLKAWWIAPTASTVIGNALDTLVFFAVAFYASSDGFMAANWQGIAF
                 130        140        150        160        170        180
                 190        200        210        220      229
orf66a.pep  VDYLFKLTVCGLFFLPAYGVILNLLTKKLTTLQTKQAQDRPAPSLQNPX
            ||||||||||| ||||||||||||||||||||||||||||||||||||
orf66-1     VDYLFKLTVCTLFFLPAYGVILNLLTKKLTTLQTKQAQDRPAPSLQNPX
                 190        200        210        220
```

Homology with a Predicted ORF from *N. gonorrhoeae*

ORF66 shows 94.2% identity over a 155aa overlap with a predicted ORF (ORF66.ng) from *N. gonorrhoeae*:

```
orf66.pep   MYAFTAAQQQKALFRLVLFHILIIAASNYLVQFPFQIFGIHTTWGAFSFPFIFLATDLTV   60
            |||:||||||||||||||||||||||||||||||||:|||||||||||||||||||||||
orf66ng     MYALTAAQQQKALFRLVLFHILIIAASNYLVQFPFRIFGIHTTWGAFSFPFIFLATDLTV   60 orf66.pep   RIFGSHLARRIIFWVMFPALLLSYVFSVLFHNGSWTGLGALSEFNTFVGRIALASFAAYA  120
            |||||||||||||||||||||:|||||||||||||||||| :|||||||||||||||||
orf66ng     RIFGSHLARRIIFWVMFPALSLSYVFSVLFHNGSWTGLGAPSQFNTFVGRIALASFAAYA  120 orf66.pep   IGQILDIFVFNKLRRLKAWWIAPNASTVIGHALDT                           155
            :||||||||:|||||||||||||| ||||||:||||
orf66ng     LGQILDIFVFDKLRRLKAWWIAPAASTVIGNALDTLVFFAVAFYASSDEFMAANWQGIAF  180
```

The complete length ORF66ng nucleotide sequence <SEQ ID 265> is:

```
  1 ATGTACGCAT TGACCGCCGC ACAGCAACAG AAGGCACTCT TCCGGCTGGT
 51 GCTTTTCCAT ATCCTCATCA TCGCCGCCAG CAACTATCTG GTGCAGTTCC
101 CCTTCCGGAT TTTCGGCATC CACACCACTT GGGGCGCGTT TTCCTTTCCC
151 TTCATCTTCC TCGCCACCGA CCTGACCGTC CGCATTTTCG GTTCGCACTT
201 GGCGCGGCGG ATTATCTTTT GGGTGATGTT CCCCGCCCTT ttgCTTTcat
251 aCGTCTTTTC CGTTTTGTTC CACAACGGCA GTTGGACGGG CTTGGGCGCG
301 ctgTCCCAAT TCAACACCTT TGTCGGACGC ATCGCGCTGG CAAGTTTTGC
351 CGCCTACGCG CTCGGACAAA TCCTTGATAT TTTCGTATTC GACAAATTAC
401 GCCGTCTGAA AGCGTGGTGG ATTGCCCCGG CCGCATCAAC CGTCATCGGC
451 AATGCACTGG ACACGTTAGT ATTTTTTGCC GTTGCCTTTT ACGCAAGCAG
501 CGATGAATTT ATGGCGGCAA ACTGGCAGGG CATCGCTTTT GTCGATTACC
551 TGTTCAAACT TACCGTCTGC ACCCTCTTCT TCCTGCCCGC CTACGGCGTG
601 ATACTGAATC TGCTGACGAA AAAACTGACG GCCCTGCAAA CCAAACAGGC
651 GCAAGACCGC CCCGTGCCCT CGCTGCAAAA TCCGTAA
```

This encodes a protein having amino acid sequence <SEQ ID 266>:

```
  1 MYALTAAQQQ KALFRLVLFH ILIIAASNYL VQFPFRIFGI HTTWGAFSFP

51 FIFLATDLTV RIFGSHLARR IIFWVMFPAL SLSYVFSVLF HNGSWTGLGA

101 PSQFNTFVGR IALASFAAYA LGQILDIFVF DKLRRLKAWW IAPAASTVIG

151 NALDTLVFFA VAFYASSDEF MAANWQGIAF VDYLFKLTVC TLFFLPAYGV

201 ILNLLTKKLT ALQTKQAQDR PVPSLQNP*
```

An alternative annotated sequence is:

```
  1 MYALTAAQQQ KALFRLVLFH ILIIAASNYL VQFPFRIFGI HTTWGAFSFP

51 FIFLATDLTV RIFGSHLARR IIFWVMFPAL LLSYVFSVLF HNGSWTGLGA

101 LSQFNTFVGR IALASFAAYA LGQILDIFVF DKLRRLKAWW IAPAASTVIG

151 NALDTLVFFA VAFYASSDEF MAANWQGIAF VDYLFKLTVC TLFFLPAYGV

201 ILNLLTKKLT ALQTKQAQDR PVPSLQNP*
```

ORF66ng and ORF66-1 show 96.1% identity in 228 aa overlap:

```
orf66-1.pep  MYAFTAAQQQKALFRLVLFHILIIAASNYLVQFPFQIFGIHTTWGAFSFPFIFLATDLTV   60
             ||| :||||||||||||||||||||||||||||||| :||||||||||||||||||||||
orf66ng      MYALTAAQQQKALFRLVLFHILIIAASNYLVQFPFRIFGIHTTWGAFSFPFIFLATDLTV   60 orf66-1.pep  RIFGSHLARRIIFWVMFPALLLSYVFSVLFHNGSWTGLGALSEFNTFVGRIALASFAAYA  120
             |||||||||||||||||||||||||||||||||||||||||: |||||||||||||||||
orf66ng      RIFGSHLARRIIFWVMFPALLLSYVFSVLFHNGSWTGLGALSQFNTFVGRIALASFAAYA  120 orf66-1.pep  IGQILDIFVFNKLRRLKAWWIAPTASTVIGNALDTLVFFAVAFYASSDGFMAANWQGIAF  180
             :|||||||||| ||||||||||| ||||||||||||||||||||||||| |||||||||
orf66ng      LGQILDIFVFDKLRRLKAWWIAPAASTVIGNALDTLVFFAVAFYASSDEFMAANWQGIAF  180 orf66-1.pep  VDYLFKLTVCTLFFLPAYGVILNLLTKKLTTLQTKQAQDRPAPSLQNPX  229
             |||||||||||||||||||||||||||||||: ||||||||| ||||||
orf66ng      VDYLFKLTVCTLFFLPAYGVILNLLTKKLTALQTKQAQDRPVPSLQNPX  229
```

Furthermore, ORF66ng shows significant homology with an *E. coli* ORF:

Based on this analysis, including the homology with the *E. coli* protein and the presence of several putative transmembrane domains in the gonococcal protein, it is predicted that these proteins from *N. meningitidis* and *N. gonorrhoeae*, and

```
sp|P37619|YHHQ_ECOLI HYPOTHETICAL 25.3 KD PROTEIN IN FTSY-NIKA
INTERGENIC REGION (O221)
>gi|1073495|pir||S47690 hypothetical protein o221 - Escherichia coli
>gi|466607 (U00039) No definition line found [Escherichia coli]
>gi|1789882 (AE000423) hypothetical 25.3 kD protein in ftsY-nikA
 intergenic region [Escherichia coli]
 Length = 221
 Score = 273 bits (692), Expect = 5e-73
 Identities = 132/203 (65%), Positives = 155/203 (76%)

Query:    1 MYALTAAQQQKALFRLVLFHILIIAASNYLVQFPFRIFGIHTTWGAFSFPFIFLATDLTV   60
            M   Q+ KALF L LFH+L+I +SNYLVQ P  I G HTTWGAFSFPFIFLATDLTV
Sbjct:    1 MNVFSQTQRYKALFWLSLFHLLVITSSNYLVQLPVSILGFHTTWGAFSFPFIFLATDLTV   60

Query:   61 RIFGSHLARRIIFWVMFPALLLSYVFSVLFHNGSWTGLGALSQFNTFVGRIALASFAAYA  120
            RIFG+ LARRIIF VM PALL+SYV S LF+ GSW G GAL+ FN FV RIA ASF AYA
Sbjct:   61 RIFGAPLARRIIFAVMIPALLISYVISSLFYMGSWQFGALAHFNLFVARIATASFMAYA  120

Query:  121 LGQILDIFVFDKLRRLKAWWIAPAASTVIGNALDTLVFFAVAFYASSDEFMAANWQGIAF  180
            LGQILD+ VF++LR+ + WW+AP AST+ GN  DTL FF +AF+ S D FMA +W  IA
Sbjct:  121 LGQILDVHVFNRLRQSRRWWLAPTASTLFGNVSDTLAFFFIAFWRSPDAFMAEHWMEIAL  180

Query:  181 VDYLFKLTVCTLFFLPAYGVILN                                      203
            VDY FK+ +  +FFLP YGV+LN
Sbjct:  181 VDYCFKVLISIVFFLPMYGVLLN                                      203
``` their epitopes, could be useful antigens for vaccines or diagnostics, or for raising antibodies.

Example 32

The following partial DNA sequence was identified in *N. meningitidis* <SEQ ID 267>:

```
  1 ATGGTCATAA AATATACAAA TTTGAATTTT GCGAAATTGT CGATAATTGC
 51 AATTTTGATG ATGTATTCGT TTGAAGCGAA TGCAAAyGCA GTmwrAATAT
101 CTGAAACTGT TTCAGTTGAT ACCGGACAAG GTGCGAAAAT TCATAAGTTT
151 GTACCTAAAA ATAGTAAAAC TTATTCATCT GATTTAATAA AAACGGTAGA
201 TTTAACACAC AyyCCTACGG GCGCAAAAGC CCGAATCAAC GCCAAAATAA
251 CCGCCAGCGT ATCCCGCGCC GGCGTATTGG CGGGGGTCGG CAAACTTGCC
301 CGCTTAGgCG CGAAATTCAG CACAAGGGCG CTtCCCTATG TCGGAACAGC
351 CcTTTTAGCC CACGACGTAT ACGAAAcTTT CAAAGAAGAC ATACAGGCAC
401 GAGGCTACCA ATACGACCCC GAAACCGACA AATTTGTAAA AGGCTACGAA
451 TATAGTAATT GCCTTTGGTA CGAAGACAAA AGACGTATTA ATAGAACCTA
501 TGGCTGCTAC GGCGTTGAT..
```

This corresponds to the amino acid sequence <SEQ ID 268; ORF72>:

```
  1 MVIKYTNLNF AKLSIIAILM MYSFEANANA VXISETVSVD
    TGQGAKIHKF
 51 VPKNSKTYSS DLIKTVDLTH XPTGAKARIN AKITASVSRA
    GVLAGVGKLA
101 RLGAKFSTRA VPYVGTALLA HDVYETFKED IQARGYQYDP
    ETDKFVKGYE
151 YSNCLWYEDK RRINRTYGCY GVD..
```

Further work revealed the complete nucleotide sequence <SEQ ID 269>:

```
  1 ATGGTCATAA AATATACAAA TTTGAATTTT GCGAAATTGT
    CGATAATTGC
 51 AATTTTGATG ATGTATTCGT TTGAAGCGAA TGCAAATGCA
    GTAAAAATAT
101 CTGAAACTGT TTCAGTTGAT ACCGGACAAG GTGCGAAAAT
    TCATAAGTTT
151 GTACCTAAAA ATAGTAAAAC TTATTCATCT GATTTAATAA
    AAACGGTAGA
201 TTTAACACAC ATCCCTACGG GCGCAAAAGC CCGAATCAAC
    GCCAAAATAA
251 CCGCCAGCGT ATCCCGCGCC GGCGTATTGG CGGGGGTCGG
    CAAACTTGCC
```

-continued

```
301 CGCTTAGGCG CGAAATTCAC CACAAGGGCG GTTCCCTATG
    TCGGAACAGC
351 CCTTTTAGCC CACGACGTAT ACGAAACTTT CAAAGAAGAC
    ATACAGGCAC
401 GAGGCTACCA ATACCACCCC GAAACCGACA AATTTGCAAA
    GGTCTCAGGC
451 TAA
```

This corresponds to the amino acid sequence <SEQ ID 270; ORF72-1>:

```
  1 MVIKYTNLNF AKLSIIAILM MYSFEANANA VKISETVSVD
    TGQGAKIHKF
 51 VPKNSKTYSS DLIKTVDLTH IPTGAKARIN AKITASVSRA
    GVLAGVGKLA
101 RLGAKFSTRA VPYVGTALLA HDVYETFKED IQARGYQYDP
    ETDKFAKVSG
151 *
```

Computer analysis of this amino acid sequence gave the following results:

Homology with a Predicted ORF from *N. meningitidis* (Strain A)

ORF72 shows 98.0% identity over a 147aa overlap with an ORF (ORF72a) from strain A of *N. meningitidis*:

```
                    10        20        30        40        50        60
orf72.pep   MVIKYTNLNFAKLSIIAILMMYSFEANANAVXISETVSVDTGQGAKIHKFVPKNSKTYSS
            ||||||||||||||||||||||||||||||| ||||||||||||||||||||||||||||
orf72a      MVIKYTNLNFAKLSIIAILMMYSFEANANAVKISETVSVDTGQGAKIHKFVPKNSKTYSS
                    10        20        30        40        50        60
```

-continued

```
                    70         80         90        100        110        120
orf72.pep   DLIKTVDLTHXPTGAKARINAKITASVSRAGVLAGVGKLARLGAKFSTRAVPYVGTALLA
            ||||||||||| ||||||||||||||||||||||||||||||||||||||||||||||||
orf72a      DLIKTVDLTHIPTGAKARINAKITASVSRAGVLAGVGKLARLGAKFSTRAVPYVGTALLA
                    70         80         90        100        110        120
                   130        140        150        160        170
orf72.pep   HDVYETFKEDIQARGYQYDPETDKFVKGYEYSNCLWYEDKRRINRTYGCYGVD
            ||||||||||||||||||||||||||| :|
orf72a      HDVYETFKEDIQARGYQYDPETDKFAKVSGX
                   130        140        150
```

The complete length ORF72a nucleotide sequence <SEQ ID 271> is:

```
  1 ATGGTCATAA AATATACAAA TTTGAATTTT GCGAAATTGT
    CGATAATTGC

51 AATTTTGATG ATGTATTCGT TGAAGCGAA TGCAAATGCA
    GTAAAAATAT

101 CTGAAACTGT TTCAGTTGAT ACCGGACAAG GTGCGAAAAT
    TCATAAGTTT

151 GTACCTAAAA ATAGTAAAAC TTATTCATCT GATTTAATAA
    AAACGGTAGA

201 TTTAACACAC ATCCCTACGG GCGCAAAAGC CCGAATCAAC
    GCCAAAATAA

251 CCGCCAGCGT ATCCCGCGCC GGCGTATTGG CCGGGGTCGG
    CAAACTTGCC

301 CGCTTAGGCG CGAAATTCAG CACAAGGGCG GTTCCCTATG
    TCGGAACAGC

351 CCTTTTAGCC CACGACGTAT ACGAAACTTT CAAAGAAGAC
    ATACAGGCAC

401 GAGGCTACCA ATACGACCCC GAAACCGACA AATTTGCAAA
    GGTCTCAGGC

451 TAA
```

This encodes a protein having amino acid sequence <SEQ ID 272>:

```
  1 MVIKYTNLNF AKLSIIAILM MYSFEANANA VKISETVSVD
    TGQGAKIHKF

51 VPKNSKTYSS DLIKTVDLTH IPTGAKARIN AKITASVSRA
    GVLAGVGKLA

101 RLGAKFSTRA VPYVGTALLA HDVYETFKED IQARGYQYDP
    ETDKFAKVSG

151 *
```

ORF72a and ORF72-1 show 100.0% identity in 150 aa overlap:

```
                    10         20         30         40         50         60
orf72a.pep  MVIKYTNLNFAKLSIIAILMMYSFEANANAVKISETVSVDTGQGAKIHKFVPKNSKTYSS
            ||||||||||||||||||||||||||||||||||||||||||||||||||||||||||||
orf72-1     MVIKYTNLNFAKLSIIAILMMYSFEANANAVKISETVSVDTGQGAKIHKFVPKNSKTYSS
                    10         20         30         40         50         60
                    70         80         90        100        110        120
orf72a.pep  DLIKTVDLTHIPTGAKARINAKITASVSRAGVLAGVGKLARLGAKFSTRAVPYVGTALLA
            ||||||||||||||||||||||||||||||||||||||||||||||||||||||||||||
orf72-1     DLIKTVDLTHIPTGAKARINAKITASVSRAGVLAGVGKLARLGAKFSTRAVPYVGTALLA
                    70         80         90        100        110        120
                   130        140        150
orf72a.pep  HDVYETFKEDIQARGYQYDPETDKFAKVSGX
            ||||||||||||||||||||||||||||||
orf72-1     HDVYETFKEDIQARGYQYDPETDKFAKVSGX
                   130        140        150
```

Homology with a Predicted ORF from *N. gonorrhoeae*

ORF72 shows 89% identity over a 173aa overlap with a predicted ORF (ORF72.ng) from *N. gonorrhoeae*:

```
orf72.pep   MVIKYTNLNFAKLSIIAILMMYSFEANANAVXISETVSVDTGQGAKIHKFVPKNSKTYSS    60
            ||:||||||||||||||||||||||||||||| ||||:|||||||:||||||:|: |||
orf72ng     MVTKHTNLNFAKLSIIAILMMYSFEANANAVKISETLSVDTGQGAKVHKFVPKSSNIYSS    60
orf72.pep   DLIKTVDLTHXPTGAKARINAKITASVSRAGVLAGVGKLARLGAKFSTRAVPYVGTALLA   120
            ||  ||||||| ||||||||||||||||||||| :|||| | |||| |||||||||||||
orf72ng     DLTKAVDLTHIPTGAKARINAKITASVSRAGVLSGVGKLVRQGAKFGTRAVPYVGTALLA   120
orf72.pep   HDVYETFKEDIQARGYQYDPETDKFVKGYEYSNCLWYEDKRRINRTYGCYGVD          173
            ||||||||||||||| :|||||||||||||| ||||||:|||||||||||||
orf72ng     HDVYETFKEDIQARGCRYDPETDKFVKGYEYANCLWYEDERRINRTYGCYGVDSSIMRLM   180
```

An ORF72ng nucleotide sequence <SEQ ID 273> was predicted to encode a protein having amino acid sequence <SEQ ID 274>:

```
  1 MVTKHTNLNF AKLSIIAILM MYSFEANANA VKISETLSVD
    TGQGAKVHKF

51 VPKSSNIYSS DLTKAVDLTH IPTGAKARIN AKITASVSRA
    GVLSGVGKLV

101 RQGAKEGTRA VPYVGTALLA HDVYETFKED IQARQCRYDP
    ETDKFVKGYE

151 YANCLWYEDE RRINRTYGCY GVDSSIMRLM PDRSRFPEVK
    QLMESQMYRL

201 ARPFWNWRKE ELNKLSSLDW NNFVLNRCTF DWNGGGCAVN
    KGDDFRAGAS

251 FSLGRNPKYK EEMDAKKPEE ILSLKVDADP DKYIEATGYP
    GYSEKVEVAP

301 GTKVNMGPVT DRNSNPVQVA ATFGRDAQGN TTADVQVIPR
    PDLTPASAEA

351 PHAQPLPEVS PAENFANNPD PDENPGTRPN PEPDPDLNPD
    ANPDTDGQPG
```

```
401 TSPDSPAVPD RPNGRHRKER KEGEDGGLSC DYFPEILACQ
    EMGKPSDRMF

451 HDISIPQVTD DKTWSSHNFL PSNGVCPQPK TFHVFGRQYR
    ASYEPLCVFA

501 EKIRFAVLLA FIIMSAFVVF GSLGGE*
```

After further analysis, the following gonococcal DNA sequence <SEQ ID 275> was identified:

```
  1 ATGGTCACAA AACATACAAA TTTGAATTTT GCGAAATTGT
    CGATAATTGC

51 AATTTTGATG ATGTATTCGT TTGAAGCGAA TGCAAATGCA
    GTAAAAATAT

101 CTGAAACTCT TTCGGTTGAT ACCGGACAAG GCGCGAAAGT
    TCATAAGTTC

151 GTTCCTAAAT CAAGTAATAT TTATTCATCT GATTTAACAA
    AAGCGGTAGA

201 TTTAACGCAT ATCCCCACGG GCGCAAAAGC CCGAATCAAC
    GCCAAAATAA
```

```
251 CCGCCAGCGT ATCCCGCGCC GGCGTATTGT CGGGGGTCGG
    CAAACTTGTC

301 CGCCAAGGCG CGAAATTCGG CACAAGGGCG GTTCCCTATG
    TCGGAACAGC

351 CCTTTTAGCC CACGACGTAT ACGAAACTTT CAAAGAAGAC
    ATACAGGCAC

401 GAGGCTGCCG ATACGATCCC GAAACCGACA AATTT
```

This corresponds to the amino acid sequence <SEQ ID 276; ORF72ng-1>:

```
  1 MVTKHTNLNF AKLSIIAILM MYSFEANANA VKISETLSVD
    TGQGAKVHKF

51 VPKSSNIYSS DLTKAVDLTH IPTGAKARIN AKITASVSRA
    GVLSGVGKLV

101 RQGAKFGTRA VPYVGTALLA HDVYETFKED IQARGCRYDP
    ETDKF
```

ORF72ng-1 and ORF721-1 show 89.7% identity in 145 aa overlap:

```
                        10         20         30         40         50         60
orf72ng-1.pe  MVTKHTNLNFAKLSIIAILMMYSFEANANAVKISETLSVDTGQGAKVHKFVPKSSNIYSS
              ||:||||||||||||||||||||||||||||||||||:|||||||:||||||:|:|||
orf72-1       MVIKYTNLNFAKLSIIAILMMYSFEANANAVKISETVSVDTGQGAKIHKFVPKNSKTYSS
                        10         20         30         40         50         60
                        70         80         90        100        110        120
orf72ng-1.pe  DLTKAVDLTHIPTGAKARINAKITASVSRAGVLSGVGKLVRQGAKFGTRAVPYVGTALLA
              ||:|:|||||||||||||||||||||||||||:||||||||::|:|:|||||||||||||
orf72-1       DLIKTVDLTHIPTGAKARINAKITASVSRAGVLAGVGKLARLGAKFSTRAVPYVGTALLA
                        70         80         90        100        110        120
                       130        140
orf72ng-1.pe  HDVYETFKEDIQARGCRYDPETDKF
              |||||||||||||||:|||||||||
orf72-1       HDVYETFKEDIQARGYQYDPETDKFAKVSGX
                       130        140        150
```

Based on this analysis, including the presence of a putative leader sequence and transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 33

The following partial DNA sequence was identified in *N. meningitidis* <SEQ ID 277>:

```
  1 ATGAGATTTT TCGGTATCGG TTTTTTGGTG CTGCTGTTTT
    TGGAGATTAT

51 GTCGATTGTG TGGGTTGCCG ATTGGCTGGG CGGCGGCTGG
    ACGTTGTTTT

101 TGATGGCGGC AGGTTTTGCC GCCGGCGTGC TGATGCTCAG
    GCAAACCGGG

151 GCTGACCGGT CTTTTATTGG CGGGCGCGGC AATGAGAAGC
    GGCGGGAAGG

201 TATCCGTTTA TCAGATGTTG TGGCCTATC...
```

This corresponds to the amino acid sequence <SEQ ID 278; ORF73>:

```
  1 MRFFGIGFLV LLFLEIMSIV WVADWLGGGW TLFLMAAGFA
    AGVLMLRQTG

51 LTGLLLAGAA MRSGGKVSVY QMLWPI...
```

Further work revealed the complete nucleotide sequence <SEQ ID 279>:

```
  1 ATGAGATTTT TCGGTATCGG TTTTTTGGTG CTGCTGTTTT
    TGGAGATTAT

51 GTCGATTGTG TGGGTTGCCG ATTGGCTGGG CGGCGGCTGG
    ACGTTGTTTT

101 TGATGGCGGC AGGTTTTGCC GCCGGCGTGC TGATGCTCAG
    GCATACGGGG

151 CTGTCCGGTC TTTTATTGGC GGGCGCGGCA ATGAGAAGCG
    GCGGGAGGGT
```

```
-continued
201 ATCCGTTTAT CAGATGTTGT GGCCTATCCG TTATACGGTG
    GCGGCTGTGT

251 GTCTGATGAG TCCGGGATTC GTATCCTCGG TGTTGGCGGT
    ATTGCTGCTG

301 CTGCCGTTTA AGGGAGGGGC AGTGTTGCAG GCAGGAGGTG
    CGGAAAATTT

351 TTTCAACATG AACCAATCGG GCAGAAAAGA GGGCTTTTCC
    CGCGATGACG

401 ATATTATCGA GGGAGAATAT ACGGTTGAAG AGCCTTACGG
    CGGCAATCGT

451 TCCCGAAACG CCATCGAACA CAAAAAGGAC GAATAA
```

This corresponds to the amino acid sequence <SEQ ID 280; ORF73-1>:

```
  1 MRFFGIGFLV LLFLEIMSIV WVADWLGGGW TLFLMAAGFA AGVLMLRHTG

51 LSGLLLAGAA MRSGGRVSVY QMLWPIRYTV AAVCLMSPGF VSSVLAVLLL

101 LPFKGGAVLQ AGGAENFFNM NQSGRKEGFS RDDDIIEGEY TVEEPYGGNR

151 SRNAIEHKKD E*
```

Computer analysis of this amino acid sequence gave the following results:

Homology with a Predicted ORF from *N. meningitidis* (Strain A)

ORF73 shows 90.8% identity over a 76aa overlap with an ORF (ORF73a) from strain A of *N. meningitidis*:

```
              10         20         30         40         50         60
orf73.pep  MRFFGIGFLVLLFLEIMSIVWVADWLGGGWTLFLMAAGFAAGVLMLRQTGLTGLLLAGAA
           ||||||||||||||||||||||||||||||||||||||| |||||:|||:|||:||||||
orf73a     MRFFGIGFLVLLFLEIMSIVWVADWLGGGWTLFLMAATFAAGVVMLRHTGLSGLLLAGAA
              10         20         30         40         50         60
              70
orf73.pep  MRSGGKVSVYQMLWPI
           ||||||:||||  |||||
orf73a     MRSGGRVSVYXMLWXIRYTVAAVCXMSPGFVSSVXAVLLXLPFKGGAVLQAGGALNFFNM
                                         50
```

The complete length ORF73a nucleotide sequence <SEQ ID 281> is:

```
  1 ATGAGATTTT TCGGTATCGG TTTTTTGGTG CTGCTGTTTT TGGAGATTAT

51 GTCGATTGTG TGGGTTGCCG ATTGGTTGGG CGGCGGTTGG ACGCTGTTTC

101 TAATGGCGGC AACCTTTGCC GCCGGCGTGG TGATGCTCAG GCATACGGGG

151 CTGTCCGGTC TTTTATTGGC GGGCGCGGCA ATGAGAAGCG GCGGGAGGGT

201 ATCCGTTTAT CANATGTTGT GGCNTATCCG TTATACGGTG GCGGCGGTGT

251 GTCNGATGAG TCCGGGATTC GTATCCTCGG TGTNGGCGGT ATTGCTGNTG

301 CTNCCGTTTA AGGGAGGTGC AGTGTTGCAG GCAGGAGGTG CGGAAAATTT
```

```
351  TTTCAACATG AACCANTCGG GCAGAAAAGA NGGCNTTTCC CGCGATGACG

401  ATATTATCGA CGGGGAATAT ACGGTTGAAG ANCCTTACGG CGGCANTCGT

451  TTCCGAAACG CCNTNGAACA CAAAAAGAC GAATAA
```

This encodes a protein having amino acid sequence <SEQ ID 282>:

```
  1  MRFFGIGFLV LLFLEIMSIV WVADWLGGGW TLFLMAATFA AGVVMLRHTG

51  LSGLLLAGAA MRSGGRVSVY XMLWXIRYTV AAVCXMSPGF VSSVXAVLLX

101  LPFKGGAVLQ AGGAENFFNM NXSGRKXGXS RDDDIIEGEY TVEXPYGGXR

151  FRNAXEHKKD E*
```

ORF73a and ORF73-1 show 91.3% identity in 161 aa overlap

```
                    10         20         30         40         50         60
   orf73a.pep  MRFFGIGFLVLLFLEIMSIVWVADWLGGGWTLFLMAATFAAGVVMIRHTGLSGLLLAGAA
               ||||||||||||||||||||||||||||||||||||| |||||:|||:||||||||||||
   orf73-1     MRFFGIGFLVLLFLEIMSIVWVADWLGGGWTLFLMAAGFAAGVLMLRHTGLSGLLLAGAA
                    10         20         30         40         50         60
                    70         80         90        100        110        120
   orf73a.pep  MRSGGRVSVYXMLWXIRYTVAAVCXMSPGFVSSVXAVLLXLPFKGGAVLQAGGAENFFNM
               |||||||||| |||||||||||||| ||||||||| |||| |||||||||||||||||||
   orf73-1     MRSGGRVSVYQMLWPIRYTVAAVCLMSPGFVSSVLAVLLLLPFKGGAVLQAGGAENFFNM
                    70         80         90        100        110        120
                   130        140        150        160
   orf73a.pep  NXSGRKXGXSRDDDIIEGEYTVEXPYGGXRFRNAXEHKKDEX
               | |||| | |||||||||||||| ||| | ||| ||||||||
   orf73-1     NQSGRKEGFSRDDDIIEGEYTVEEPYGGNRSRNAIEHKKDEX
                   130        140        150        160
```

Homology with a Predicted ORF from *N. gonorrhoeae*

ORF73 shows 92.1% identity over a 76aa overlap with a predicted ORF (ORF73.ng) from *N. gonorrhoeae*:

```
   orf73.pep  MRFFGIGFLVLLFLEIMSIVWVADWLGGGWTLFLMAAGFAAGVLMLRQTGLTGLLLAGAA   60
              ||||||||||||||||||||||||||||||||||||||||||||||||:|||:|||||||
   orf73ng    MRFFGIGFLVLLFLEIMSIVWVADWLGGGWTLFLMAATFAAGVLMLRHTGLSGLLLAGAA   60
   orf73.pep  MRSGGKVSVYQMLWPI                                              76
              ::|:||||||||||||
   orf73ng    VKSSGKVSVYQMLWPIRYTVAAVCLMSPGVSSVLAVLLLLPFKGGAVLQAGGAENFFNM  120
```

The complete length ORF73ng nucleotide sequence <SEQ ID 283> is:

```
  1  ATGAGATTTT TCGGTATCGG TTTTTTGGTG CTGCTGTTTT TGGAAATTAT

51  GTCGATTGTG TGGGTTGCCG ATTGGCTGGG CGGCGGTTGG AcgcTGTTTC
```

```
101  TAATGGCGGC AACCTTTGCC GCCGGTGTGC TGATGCTCAG GCATAcggGG
151  CTGTCCGGTC TTTTATTGGC TGGCGCGGCG GTAAAAagta gtgGGAAGGT
201  ATCTGTTTAT CagatgtTGT GGCCTATCCG TTATAcggtg gcggcggtgT
251  GTCTGatgag tCcggGATTC GTATCCTccg tgttggCGGT ATTGCTGCTG
301  CTGCcgttta aggGaggGgc agtgttgcag gcaggaggtg cggaaaATTT
351  TTTCAACATg aaCcaatcgg gcagaaAaga gggattttc cacgatgacg
401  atattatcga gggagaatat acggttgaaa aacctgacgg cggcaatcgt
451  tcccgaAAcg ccatcgaaca cgaaaAagac gaataA
```

This encodes a protein having amino acid sequence <SEQ ID 284>:

```
  1  MRFFGIGFLV LLFLEIMSIV WVADWLGGGW TLFLMAATFA AGVLMLRHTG
 51  LSGLLLAGAA VKSSGKVSVY QMLWPIRYTV AAVCLMSPGF VSSVLAVLLL
101  LPFKGGAVLQ AGGAENFFNM NQSGRKEGFF HDDDIIEGEY TVEKPDGGNR
151  SRNAIEHEKD E*
```

ORF73ng and ORG73-1 show 93.8% identity in 161 aa overlap

```
                  10         20         30         40         50         60
orf73-1.pep  MRFFGIGFLVLLFLEIMSIVWVADWLGGGWTLFLMAAGFAAGVLMLRHTGLSGLLLAGAA
             ||||||||||||||||||||||||||||||||||||| ||||||||||||||||||||||
orf73ng      MRFFGIGFLVLLFLEIMSIVWVADWLGGGWTLFLMAATFAAGVLMLRHTGLSGLLLAGAA
                  10         20         30         40         50         60

70         80         90        100        110        120
orf73-1.pep  MRSGGRVSVYQMLWPIRYTVAAVCLMSPGFVSSVLAVLLLLPFKGGAVLQAGGAENFFNM
             ::|:|:|||||||||||||||||||||||||||||||||||||||||||||||||||||
orf73ng      VKSSGKVSVYQMLWPIRYTVAAVCLMSPGFVSSVLAVLLLLPFKGGAVLQAGGAENFFNM
                  70         80         90        100        110        120

130        140        150        160
orf73-1.pep  NQSGRKEGFSRDDDIIEGEYTVEEPYGGNRSRNAIEHKKDEX
             |||||||||:||||||||||||:|||||||||||||||:|||
orf73ng      NQSGRKEGFFHDDDIIEGEYTVEKPDGGNRSRNAIEHEKDEX
                 130        140        150        160
```

Based on this analysis, including the presence of a putative leader sequence and putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 34

The following partial DNA sequence was identified in *N. meningitidis* <SEQ ID 285>:

```
  1  ATGTTTGTTT TTCAGACGGC ATTCTT.ATG TTTCAGAAAC ATTTGCAGAA
 51  AGCCTCCGAC AGCGTCGTCG GAGGGACATT ATACGTGGTT GCCACGCCCA
```

-continued

```
101  TCGGCAATTT GGCGGACATT ACCCTGCGCG CTTTGGCGGT ATTGCAAAAG
151  GCG........ .....GCCGA AGACACGCGC GTTACCGCAC AGCTTTTGAG
201  CGCGTACGGC ATTCAGGGCA AACTCGTCAG TGTGCGCGAA CACAACGAAC
251  GGCAGATGGC GGACAAGATT GTCGGCTATC TTTCAGACGG CATGGTTGTG
301  GCACAGGTTT CCGATGCGGG TACGCCGGCC GTGTGCGACC CGGGCGCGAA
351  ACTCGCCCGC CGCGTGCGTG AGGCCGGGTT TAAAGTCGTT CCCGTCGTGG
401  GCGCAAC.GC GGTGATGGCG GCTTTGAGCG TGGCCGGTGT GGAAGGATCC
451  GATTTTTATT TCAACGGTTT TGTACCGCCG AAATCGGGAG AACGCAGGAA
501  ACTGTTTGCC AAATGGGTGC GGGCGGCGTT TCCTATCGTC ATGTTTGAAA
551  CGCCGCACCG CATCGGTGCA GCGCTTGCCG ATATGGCGGA ACTGTTCCCC
601  GAACGCCGAT TAATGCTGGC GCGCGAAATT ACGAAACGT  TTGAAACGTT
651  CTTAAGCGGC ACGGTTGGGG AAATTCAGAC GGCATTGTCT GCCGACGGCG
701  ACCAATCGCG CGGCGAGATG GTGTTGGTGC TTTATCCGGC GCAGGATGAA
751  AAACACGAAG GCTTGTCCGA GTCCGCGCAA AACATCATGA AAATCCTCAC
801  AGCCGAGCTG CCGACCAAAC AGGCGGCGGA GCTTGCTGCC AAAATCACGG
851  GCGAGGGAAA GAAAGCTTTG TACGAT..
```

This corresponds to the amino acid sequence <SEQ ID 286; ORF75>:

```
  1  MFVFQTAFXM FQKHLQKASD SVVGGTLYVV ATPIGNLADI TLRALAVLQK
 51  A....AEDTR VTAQLLSAYG IQGKLVSVRE HNERQMADKI VGYLSDGMVV
101  AQVSDAGTPA VCDPGAKLAR RVREAGFKVV PVVGAXAVMA ALSVAGVEGS
151  DFYFNGFVPP KSGERRKLFA KWVRAAFPIV MFETPHRIGA ALADMAELFP
201  ERRLMLAREI TKTFETFLSG TVGEIQTALS ADGDQSRGEM VLVLYPAQDE
251  KHEGLSESAQ NIMKILTAEL PTKQAAELAA KITGEGKKAL YD..
```

Further work revealed the complete nucleotide sequence <SEQ ID 287>:

```
  1  ATGTTTCAGA AACATTTGCA GAAAGCCTCC GACAGCGTCG TCGGAGGGAC
 51  ATTATACGTG GTTGCCACGC CCATCGGCAA TTTGGCGGAC ATTACCCTGC
101  GCGCTTTGGC GGTATTGCAA AAGGCGGACA TCATCTGTGC CGAAGACACG
151  CGCGTTACCG CACAGCTTTT GAGCGCGTAC GGCATTCAGG GCAAACTCGT
201  CAGTGTGCGC GAACACAACG AACGGCAGAT GGCGGACAAG ATTGTCGGCT
251  ATCTTTCAGA CGGCATGGTT GTGGCACAGG TTTCCGATGC GGGTACGCCG
301  GCCGTGTGCG ACCCGGGCGC GAAACTCGCC CGCCGCGTGC GTGAGGCCGG
351  GTTTAAAGTC GTTCCCGTCG TGGGCGCAAG CGCGGTGATG CGGCTTTGA
401  GCGTGGCCGG TGTGGAAGGA TCCGATTTTT ATTTCAACGG TTTTGTACCG
451  CCGAAATCGG GAGAACGCAG GAAACTGTTT GCCAAATGGG TGCGGGCGGC
501  GTTTCCTATC GTCATCTTTG AAACGCCGCA CCGCATCGGT GCGACGCTTG
```

```
551 CCGATATGGC GGAACTGTTC CCCGAACGCC GATTAATGCT GGCGCGCGAA

601 ATTACGAAAA CGTTTGAAAC GTTCTTAAGC GGCACGGTTG GGGAAATTCA

651 GACGGCATTG TCTGCCGACG GCAACCAATC GCGCGGCGAG ATGGTGTTGG

701 TGCTTTATCC GGCGCAGGAT GAAAAACACG AAGGCTTGTC CGAGTCCGCG

751 CAAAACATCA TGAAAATCCT CACAGCCGAG CTGCCGACCA AACAGGCGGC

801 GGAGCTTGCT GCCAAAATCA CGGGCGAGGG AAAGAAAGCT TTGTACGATC

851 TGGCTCTGTC TTGGAAAAAC AAATAG
```

This corresponds to the amino acid sequence <SEQ ID 288; ORF75-1>:

```
  1 MFQKHLQKAS DSVVGGTLYV VATPIGNLAD ITLRALAVLQ KADIICAEDT

51 RVTAQLLSAY GIQGKLVSVR EHNERQMADK IVGYLSDGMV VAQVSDAGTP

101 AVCDPGAKLA RRVREAGFKV VPVVGASAVM AALSVAGVEG SDFYFNGFVP

151 PKSGERRKLF AKWVRAAFPI VMFETPHRIG ATLADMAELF PERRLMLARE

201 ITKTFETFLS GTVGEIQTAL SADGNQSRGE MVLVLYPAQD EKHEGLSESA

251 QNIMKILTAE LPTKQAAELA AKITGEGKKA LYDLALSWKN K*
```

Computer analysis of this amino acid sequence gave the following results:

Homology with a Predicted ORF from *N. meningitidis* (Strain A)

ORF75 shows 95.8% identity over a 283aa overlap with an ORF (ORF75a) from strain A of *N. meningitidis*:

```
                    10         20         30         40         50         60
    orf75.pep  MFVFQTAFXMFQKHLQKASDSVVGGTLYVVATPIGNLADITLRALAVLQKAXXXXAEDTR
                        ||||||||||||||||||||||||||||||||||||||     |||||
    orf75ng              MFQKHLQKASDSVVGGTLYVVATPIGNLADITLRALAVLQKADIICAEDTR
                                 10         20         30         40         50

70         80         90        100        110        120
    orf75.pep  VTAQLLSAYGIQGKLVSVREHNERQMADKIVGYLSDGMVVAQVSDAGTPAVCDPGAKLAR
               ||||||||||||||||||||||||||||||||||||||||||||||||||||||||||||
    orf75ng    VTAQLLSAYGIQGKLVSVREHNERQMADKIVGYLSDGMVVAQVSDAGTPAVCDPGAKLAR
                        60         70         80         90        100        110

130        140        150        160        170        180
    orf75.pep  RVREAGFKVVPVVGAXAVMAALSVAGVEGSDFYFNGFVPPKSGERRKLFAKWVRAAFPIV
               ||||:|||||||||| ||||||||||| ||||||||||||||||||||||||||:|||:|
    orf75a     RVREVGFKVVPVVGASAVMAALSVAGVAGSDFYFNGFVPPKSGERRKLFAKWVRVAFPVV
                        120        130        140        150        160        170

190        200        210        220        230        240
    orf75.pep  MFETPHRIGAALADMAELFPERRLMLAREITKTFETFLSGTVGEIQTALSADGDQSRGEM
               ||||||||||:|||||||||||||||||||||||||||||||||||||||:|||:|||||
    orf75a     MFETPHRIGATLADMAELFPERRLMLAREITKTFETFLSGTVGEIQTALAADGNQSRGEM
                        180        190        200        210        220        230
```

```
              250       260       270       280       290
orf75.pep  VLVLYPAQDEKHEGLSESAQNIMKILTAELPTKQAAELAAKITGEGKKALYD
           ||||||||||||||||||||||||||||||||||||||||||||||||||||
orf75a     VLVLYPAQDEKHEGLSESAQNIMKILTAELPTKQAAELAAKITGEGKKALYDLALSWKNK
              240       250       260       270       280       290
orf75a     X
```

The complete length ORF75a nucleotide sequence <SEQ ID 289> is:

```
  1  ATGTTTCAGA AACATTTGCA GAAAGCCTCC GACAGCGTCG TCGGAGGGAC
 51  ATTATACGTG GTTGCCACGC CCATCGGCAA TTTGGCGGAC ATTACCCTGC
101  GCGCTTTGGC GGTATTGCAA AAGGCGGACA TCATCTGTGC CGAAGACACG
151  CGCGTTACCG CGCAGCTTTT GAGCGCGTAC GGCATTCAGG GCAAACTCGT
201  CAGCGTGCGC GAACACAACG AACGGCAGAT GGCGGACAAG ATTGTCGGCT
251  ATCTTTCAGA CGGCATGGTT GTGGCACAGG TTTCCGATGC GGGTACGCCG
301  GCCGTGTGCG ACCCGGGCGC GAAACTCGCC CGCCGCGTGC GTGAGGTCGG
351  GTTTAAAGTT GTCCCTGTTC TCGGCGCAAG CGCGGTGATG CCGGCTTTGA
401  GTGTGGCTGG TGTGGCGGGA TCCGATTTTT ATTTCAACGG TTTTGTACCG
451  CCGAAATCGG GCGAACGTAG GAAATTGTTT GCCAAATGGG TGCGGGTGGC
501  GTTTCCCGTC GTGATGTTTG AAACGCCGCA CCGCATCGGG GCGACGCTTG
551  CCGATATGGC GGAACTGTTC CCCGAACGCC GATTAATGCT GGCGCGCGAA
601  ATCACGAAAA CGTTTGAAAC GTTCTTAAGC GGCACGGTTG GGGAAATTCA
651  GACGGCATTG GCGGCGGACG GCAACCAATC GCGCGGCGAG ATGGTGTTGG
701  TGCTTTATCC GGCGCAGGAT GAAAAACACG AAGGCTTGTC CGAGTCCGCG
751  CAAAACATCA TGAAAATCCT CACAGCCGAG CTGCCGACCA AACAGGCGGC
801  GGAGCTTGCC GCCAAAATCA CGGGCGAGGG AAAAAAAGCT TTGTACGATC
851  TGGCACTGTC TTGGAAAAAC AAATGA
```

This encodes a protein having amino acid sequence <SEQ ID 290>:

```
  1 MFQKHLQKAS DSVVGGTLYV VATPIGNLAD ITLRALAVLQ KADIICAEDT
 51 RVTAQLLSAY GIQGKLVSVR EHNERQMADK IVGYLSDGMV VAQVSDAGTP
101 AVCDPGAKLA RRVREVGFKV VPVVGASAVM AALSVAGVAG SDFYFNGFVP
151 PKSGERRKLF AKWVRVAFPV VMFETPHRIG ATLADMAELF PERRLMLARE
201 ITKTFETFLS GTVGEIQTAL AADGNQSRGE MVLVLYPAQD EKHEGLSESA
251 QNIMKILTAE LPTKQAAELA AKITGEGKKA LYDLALSWKN K*
```

ORF75a and ORF75-1 show 98.3% identity in 291 aa overlap:

```
                      10         20         30         40         50         60
orf75a.pep  MFQKHLQKASDSVVGGTLYVVATPIGNLADITLRALAVLQKADIICAEDTRVTAQLLSAY
            ||||||||||||||||||||||||||||||||||||||||||||||||||||||||||||
orf75-1     MFQKHLQKASDSVVGGTLYVVATPIGNLADITLRALAVLQKADIICAEDTRVTAQLLSAY
                      10         20         30         40         50         60
```

-continued

```
                    70        80        90       100       110       120
orf75a.pep  GIQGKLVSVREHNERQMADKIVGYLSDGMVVAQVSDAGTPAVCDPGAKLARRVREVGFKV
            ||||||||||||||||||||||||||||||||||||||||||||||||||||||:||||
orf75-1     GIQGKLVSVREHNERQMADKIVGYLSDGMVVAQVSDAGTPAVCDPGAKLARRVREAGFKV
                    70        80        90       100       110       120
                   130       140       150       160       170       180
orf75a.pep  VPVVGASAVMAALSVAGVAGSDFYFNGFVPPKSGERRKLFAKWVRVAFPVVMFETPHRIG
            ||||||||||||||||| ||||||||||||||||||||||||||||:|||:|||||||||
orf75-1     VPVVGASAVMAALSVAGVEGSDFYFNGFVPPKSGERRKLFAKWVRAAFPIVMFETPHRIG
                   130       140       150       160       170       180
                   190       200       210       220       230       240
orf75a.pep  m ATLADMAELFPERRLMLAREITKTFETFLSCTVGEIQTALAADGNQSRGEMVLVLYPAQD
              |||||||||||||||||||||||||||||||| |||||||:|||||||||||||||||||
orf75-1       ATLADMAELFPERRLMLAREITKTFETFLSGTVGEIQTALSADGNQSRGEMVLVLYPAQD
                   190       200       210       220       230       240
                   250       260       270       280       290
orf75a.pep  EKHEGLSESAQNIMKILTAELPTKQAAELAAKITGEGKKALYDLALSWKNKX
            ||||||||||||||||||||||||||||||||||||||||||||||||||||
orf75-1     EKHEGLSESAQNIMKILTAELPTKQAAELAAKITGEGKKALYDLALSWKNKX
                   250       260       270       280       290
```

Homology with a Predicted ORF from *N. gonorrhoeae*

ORF75 shows 93.2% identity over a 292aa overlap with a predicted ORF (ORF75.ng) from *N. gonorrhoeae*:

```
orf75.pep  MFVFQTAFXMFQKHLQKASDSVVGGTLYVVATPIGNLADITLRALAVLQKA----AEDTR   56
           | ||||||  |||||||||||||||||||||||||||||||||||||||||    |||||
orf75ng    MSVFQTAFFMFQKHLQKASDSVVGGTLYVVATPUGNLADITLRALAVLQKADIICAEDTR   60 orf75.pep  VTAQLLSAYGIQGKLVSVREHNERQMADKIVGYLSDGMVVAQVSDAGTPAVCDPGAKLAR  116
           |||||||||||| ||||||||||||||||| ::|:|||| ||||||||||||||||||||
orf75ng    VTAQLLSAYGIQGRLVSVREHNERQMADKVIGFLSDGLVVAQVSDAGTPAVCDPGAKLAR  120 orf75.pep  RVREAGFKVVPVVGAXAVMAALSVAGVEGSDFYFNGFVPPKSGERRKLFAKWVRAAFPIV  176
           ||||||||||||||| |||||||||||  ||||||||||||||||||||||||||||:|
orf75ng    RVREAGFKVVPVVGASAVMAALSVAGVAESDFYFNGFVPPKSGERRKLFAKWVRAAFPVV  180 orf75.pep  MFETPHRIGAALADMAELFPERRLMLAREITKTFETFLSGTVGEIQTALSADGQSRGEM  236
           |||||||||:||||||||||||||||||||||||||||||||||||||||:|||:||||
orf75ng    MFETPHRIGATLADMAELFPERRLMLAREITKTFETFLSGTVGEIQTALAADGNQSRGEM  240 orf75.pep  VLVLYPAQDEKHEGISESAQNIMKILTAELPTKQAAELAAKITGEGKKALYD          288
           ||||||||||||||:||||||||||| ||||||||| ||||||||||||||
orf75ng    VLVLYPAQDEKHEGLSESAQNAMKILAAELPTKQAAFLAAKITGEGKKALYDLALSWKNK  300
```

An ORF75ng nucleotide sequence <SEQ ID 291> was predicted to encode a protein having amino acid sequence <SEQ ID 292>:

```
  1 MSVFQTAFFM FQKHLQKASD SVVGGTLYVV ATPIGNLADI
    TLRALAVLQK

51 ADIICAEDTR VTAQLLSAYG IQGRLVSVRE HNERQMADKV
    IGFLSDGLVV

101 AQVSDAGTPA VCDPGAKLAR RVREAGFKVV FVVGASAVMA
    ALSVAGVAES

151 DFYFNCFVPP KSGERRKLFA KWVRAAFPVV MFETPHRIGA
    TLADMAELFP

201 ERRLMLAREI TKTFETELSG TVGEIQTALA ADGNQSRGEM
    VLVLYPAQDE

251 KHECLSESAQ NAMKILAAEL PTKQAAELAA KITGEGKKAL
    YDLALSWKNK

301 *
```

After further analysis, the following gonococcal DNA sequence <SEQ ID 293> was identified:

```
  1 ATGTTTCAGA AACACTTGCA GAAAGCCTCC GACAGCGTCG
    TCGGAGGGAC

51 ATTATACGTG GTTGCCACGC CCATCGGCAA TTTGGCAGAC
    ATTACCCTGC

101 GCGCTTTGGC GGTATTGCAA AAGGCGGACA TCATTTGTGC
    CGAAGACACG
```

```
151 CGCGTTACTG CGCAGCTTTT GAGCGCGTAC GGCATTCAGG
    GCAGGTTGGT
201 CAGTGTGCGC GAACACAACG AGCGGCAGAT GGCGGACAAG
    GTAATCGGTT
251 TCCTTTCAGA CCGCCTGGTT GTGGCGCAGG TTTCCGATGC
    GGGTACGCCG
301 GCCGTGTGCG ACCCGGGCGC GAAACTCGCC CGCCGCGTGC
    GCGAAGCAGG
351 GTTCAAAGTC GTTCCCGTCG TGGGCGCAAG CGCGGTAATG
    GCGGCGTTGA
401 GTGTGGCCGG TGTGGCGGAA TCCGATTTTT ATTTCAACGG
    TTTTGTACCG
451 CCGAAATCGG GCGAACGTAG GAAATTGTTT GCCAAATGGG
    TGCGGGCGGC
501 ATTTCCTGTC GTCATGTTTG AAACGCCGCA CCGAATCGGG
    GCAACGCTTG
551 CCGATATGGC GGAATTGTTC CCCGAACGCC GTCTGATGCT
    GGCGCGCGAA
601 ATCACGAAAA CGTTTGAAAC GTTCTTAAGC GGCACGGTTG
    GGGAAATTCA
651 GACGGCATTG GCGGCGGACG GCAACCAATC GCGCGGCGAG
    ATGGTGTTGG
```

```
701 TGCTTTATCC GGCGCAGGAT GAAAACACG AAGGCTTGTC
    CGAGTCTGCG
751 CAAAATGCGA TGAAAATCCT TGCGGCCGAG CTGCCGACCA
    AGCAGGCGGC
801 GGAGCTTGCC GCCAAGATTA CAGGTGAGGG CAAAAAGGCT
    TTGTACGATT
851 TGGCACTGTC GTGGAAAAAC AAATGA
```

This corresponds to the amino acid sequence <SEQ ID 294; ORF75ng-1>:

```
  1 MFQKHLQKAS DSVVGGTLYV VATPIGNLAD ITLRALAVLQ
    KADIICAEDT
 51 RVTAQLLSAY GIQGRLVSVR EHNERQMADK VIGFLSDGLV
    VAQVSDAGTP
101 AVCDPGAKLA RRVREAGFKV VPVVGASAVM AALSVAGVAE
    SDFYFNGFVP
151 PKSGERRKLF AKWVRAAFPV VMFETPHRIG ATLADMAELF
    PERRLMLARE
201 ITKTFETFLS GTVGEIQTAL AADGNQSRGE MVLVLYPAQD
    EKHEGLSESA
251 QNAMKILAAE LPTKQAAELA AKITGEGKKA LYDLALSWKN K*
```

ORF75ng-1 and ORF75-1 show 96.2% identity in 291 aa overlap:

```
                   10         20         30         40         50         60
orf75-1.pep   MFQKHLQKASDSVVGGTLYVVATPIGNLADITLRALAVLQKADIICAEDTRVTAQLLSAY
              ||||||||||||||||||||||||||||||||||||||||||||||||||||||||||||
orf75ng-1     MFQKHLQKASDSVVGGTLYVVATPIGNLADITLRALAVLQKADIICAEDTRVTAQLLSAY
                   10         20         30         40         50         60

70         80         90        100        110        120
orf75-1.pep   GIQGKLVSVREHNERQMADKIVGYLSDGMVVAQVSDAGTPAVCDPGAKLARRVREAGFKV
              ||||:|||||||||||||||||::|:||||:|||||||||||||||||||||||||||||
orf75ng-1     GIQGRLVSVREHNERQMADKVIGFLSDGLVVAQVSDAGTPAVCDPGAKLARRVREAGFKV
                   70         80         90        100        110        120

130        140        150        160        170        180
orf75-1.pep   VPVVGASAVMAALSVAGVEGSDFYFNGFVPPKSGERRKLFAKWVRAAFPIVMFETPHRIG
              ||||||||||||||||||| ||||||||||||||||||||||||||||||:|||||||||
orf75ng-1     VPVVGASAVMAALSVAGVAESDFYFNGFVPPKSGERRKLFAKWVRAAFPVVMFETPHRIG
                  130        140        150        160        170        180

190        200        210        220        230        240
orf75-1.pep   ATLADMAELFPERRLMLAREITKTFETFLSGTVGEIQTALSADGNQSRGEMVLVLYPAQD
              ||||||||||||||||||||||||||||||||||||||||:|||||||||||||||||||
orf75ng-1     ATLADMAELFPERRLMLAREITKTFETFLSGTVGEIQTALAADGNQSRGEMVLVLYPAQD
                  190        200        210        220        230        240

250        260        270        280        290
orf75-1.pep   EKHEGLSESAQNIMKILTAELPTKQAAELAAKITGEGKKALYDLALSWKNKX
              ||||||||||||:|||:|||||||||||||||||||||||||||||||||||
orf75ng-1     EKHEGLSESAQNAMKILAAELPTKQAAELAAKITGEGKKALYDLALSWKNKX
                  250        260        270        280        290
```

Furthermore, ORG75ng-1 shows significant homology to a hypothetical *E. coli* protein:

```
sp|P45528|YRAL_ECOLI HYPOTHETICAL 31.3 KD PROTEIN IN AGAI-MTR INTERGENIC
REGION (F286)
>gi|606086 (U18997) ORF_f286 [Escherichia coli]
>gi|1789535 (AE000395) hypothetical 31.3 kD protein in agai-mtr
intergenic region [Escherichia coli   Length = 286
Score = 218 bits (550), Expect = 3e-56
Identities = 128/284 (45%), Positives = 171/284 (60%), Gaps = 4/284 (1%)

Query:    4 KHLQKASDSVVGGTLYVVATPIGNLADITLRALAVLQKADIICAEDTRVTAQLLSAYGIQ   63
            K Q A +S   G LY+V TPIGNLADIT RAL VLQ  D+I AEDTR T  LL  +GI
Sbjct:    2 KQHQSADNSQ--GQLYIVPTPIGNLADITQRALEVLQAVDLIAAEDTRHTGLLLQHFGIN   59

Query:   64 GRLVSVREHNERQMADKVIGFLSDGLVVAQVSDAGTPAVCDPGAKLARRVREAGFKVVPV  123
             RL ++ +HNE+Q A+ ++  L +G  +A VSDAGTP + DPG  L R  REAG +VP+
Sbjct:   60 ARLFALHDHNEQQKAETLLAKLQEGQNIALVSDAGTPLINDPGYHLVRTCREAGIRVVPL  119

Query:  124 VGASAVMAALSVAGVAESDFYFNGFVPPKSGERRKLFAKWVRAAFPVVMFETPHRIGATL  183
             G  A + ALS AG+     F + GF+P KS  RR          ++ +E+ HR+  +L
Sbjct:  120 PGPCAAITALSAAGLPSDRFCYEGFLPAKSKGRRDALKAIEAEPRTLIFYESTHRLLDSL  179

Query:  184 ADMAELFPERR-LMLAREITKTFETFLSGTVGEIQTALAADGNQSRGEMVLVLYPAQDEK  242
             D+ +  E R ++LARE+TKT+ET    VGE+  +   D N+ +GEMVL++       +
Sbjct:  180 EDIVAVLGESRYVVLARELTKTWETIHGAPVGELLAWVKEDENRRKGEMVLIV-EGHRAQ  238

Query:  243 HEGLSESAQNMKILAAELPTKQAAELAAKITGEGKKALYDLAL                  286
              E L    A   + +L AELP K+AA LAA+I G  K ALY  AL
Sbjct:  239 EEDLPADALRTLALLQAELPLKKAAALAAEIHGVKKNALYKYAL                 282
```

Based on this analysis, including the presence of a putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 35

The following partial DNA sequence was identified in *N. meningitidis* <SEQ ID 295>:

```
  1 ATGAAACAGA AAAAACCGC TGCCGCAGTT ATTGCTGCAA
    TGTTGGCAGG

51 TTTTGCGGCA GC.AAAGCAC CCGAAATCGA CCCGGCTTTG
    ..........

//

651 .......... ...GAGTTGG TCAGAAACCA GTTGGAGCAG
    GGTTTGAGAC

701 AGGAAAAAGC CCGCTTGAAA ATCGATGCCC TTTTGGAAGA
    AAACGGTGTC

751 AAACCGTAA
```

This corresponds to the amino acid sequence <SEQ ID 296; ORF76>:

```
  1 MKQKKTAAAV IAAMLAGFAA XKAPEIDPAL ..........
    ..........
                         //
201 .......... .......... ELVRNQLEQG LRQEKARLKI
    DALLEENGVK

251 P*
```

Further work revealed the complete nucleotide sequence <SEQ ID 297>:

```
  1 ATGAAACAGA AAAAACCGC TGCCGCAGTT ATTGCTGCAA
    TGTTGGCAGG

51 TTTTGCGGCA CCCAAAGCAC CCGAAATCGA CCCGGCTTTG
    GTGGATACGC

101 TGGTGGCGCA GATCATGCAG CAGGCAGACC GGCATGCGGA
    GCAGTCCCAA

151 AAACCGGACG GGCAGGCAAT CCGAAACGAT GCCGTCCGCC
    GGCTACAAAC

201 TTTGGAAGTT TTGAAAAACA GGGCATTGAA GGAAGGTTTG
    GATAAGGATA

251 AGGATGTCCA AAACCGCTTT AAAATCGCCG AAGCGTCTTT
    TTATGCCGAG

301 GAGTACGTCC GTTTTCTGGA ACGTTCGGAA ACGGTTTCCG
    AAGACGAGCT

351 GCACAAGTTT TACGAACAGC AAATCCGCAT GATCAAATTG
    CAGCAGGTCA

401 GCTTCGCAAC CGAAGAGGAG GCGCGTCAGG CGCAGCAGCT
    CCTGCTCAAA

451 GGGCTGTCTT TTGAAGGGCT GATGAAGCGT TATCCGAACG
    ACGAGCAGGC

501 TTTTGACGGT TTCATTATGG CGCAGCAGCT TCCCGAGCCG
    CTGGCTTCGC

551 AGTTTGCCGC GATGAATCGG GGCGACGTTA CCCGCGATCC
    GGTCAAATTG

601 GGCGAACGCT ATTATCTGTT CAAACTCAGC GAGGTCGGGA
    AAAACCCCGA

651 CGCGCAGCCT TTCGAGTTGG TCAGAAACCA GTTCGAGCAG
    GGTTTGAGAC
```

-continued

```
701 AGGAAAAAGC CCGCTTGAAA ATCGATGCCC TTTTGGAAGA
    AAACGGTGTC

751 AAACCGTAA
```

This corresponds to the amino acid sequence <SEQ ID 298; ORF76-1>:

```
  1 MKQKKTAAAV IAAMLAGFAA AKAPEIDPAL VDTLVAQIMQ
    QADRHAEQSQ

51 KPDGQAIRND AVRRLQTLEV LKNRALKEGL DKDKDVQNRF
    KIAEASFYAE

101 EYVRFLERSE TVSEDELHKF YEQQIRMIKL QQVSFATEEE
    ARQAQQLLLK

151 GLSFEGLMKR YPNDEQAFDG FIMAQQLPEP LASQFAAMNR
    GDVTRDPVKL

201 GERYYLFKLS EVGKNPDAQP FELVRNQLEQ GLRQEKARLK
    IDALLEENGV

251 KP*
```

Computer analysis of this amino acid sequence gave the following results:

Homology with a Predicted ORF from *N. meningitidis* (Strain A)

ORF76 shows 96.7% identity over a 30aa overlap and 96.8% identity over a 31 aa overlap with an ORF (ORF76a) from strain A of *N. meningitidis*:

```
                 10         20         30
orf76.pep  MKQKKTAAAVIAAMLAGFAAXKAPEIDPAL
           ||||||||||||||||||||| |||||||||
orf76a     MKQKKTAAAVIAAMLAGFAAAKAPEIDPALVDTLVAQIMQQADRHAEQSQKPDGQAIRND
                 10         20         30        40         50         60

//

70         80         90
orf76.pep                  XELVRNQLEQGLRQEKARLKIDALLEENGVKPX
                           |||||||||||||||||||||||:||||||||
orf76a     DVTRDPVKLGERYYLFKLSEVGKNPDAQPFELVRNQLEQGLRQEKARLKIDAILEENGVKPX
                    200        210        220        230        240        250
```

The complete length ORF76a nucleotide sequence <SEQ ID 299> is:

```
  1 ATGAAACAGA AAAAACCGC TGCCGCAGTT ATTGCTGCAA
    TGTTGGCAGG

51 TTTTGCGGCA GCCAAAGCAC CGAAATCGA CCCGGCTTTG
    GTGGATACGC

101 TGGTGGCGCA GATCATGCAG CAGGCAGACC GGCATGCGGA
    GCAGTCCCAA

151 AAACCGGACG GCAGGCAAT CCGAAACGAT GCCGTCCGTC
    GGCTGCAAAC

201 TTTGGAAGTT TGAAAAACA GGGCATTGAA GGAAGGTTTG
    GATAAGGATA
```

```
251 AGGATGTCCA AAACCGCTTT AAAATCGCCG AAGCGTCTTT
    TTATGCCGAG

301 GAGTACGTCC GTTTTCTGGA ACGTTCGGAA ACGGTTTCCG
    AAAGCGCACT

351 GCGTCAGTTT TATCAGCGGC AAATCCGCAT GATCAAATTG
    CAGCAGGTCA

401 GCTTCGCAAC CGAAGAGGAG GCGCGTCAGG CGCAGCAGCT
    CCTGCTCAAA

451 GGGCTGTCTT TTGAAGGGCT GATGAAGCGT TATCCGAACG
    ACGAGCAGGC

501 TTTTGACGGT TTCATTATGG CGCAGCAGCT TCCCGAGCCG
    CTGGCTTCGC

551 AGTTTGCAGC GATGAATCGG GGCGACGTTA CCCGCGATCC
    GGTCAAATTG

601 GCCGAACGCT ATTATCTGTT CAAACTCAGC GAGGTCGGGA
    AAAACCCCGA

651 CGCGCAGCCT TTCGAGTTGG TCAGAAACCA GTTGGAACAA
    GGTTTGAGAC

701 AGGAAAAAGC CCGCTTGAAA ATCGATGCCA TTTTGGAAGA
    AAACGGTGTC

751 AAACCGTAA
```

This encodes a protein having amino acid sequence <SEQ ID 300>:

```
  1 MKQKKTAAAV IAAMLAGFAA AKAPEIDPAL VDTLVAQIMQ
    QADRHAEQSQ

51 KPDGQAIRND AVRRLQTLEV LKNPALKEGL DKDKDVQNRF
    KIAEASFYAE

101 EYVRFLERSE TVSESALRQF YERQIRMIKL QQVSFATEEE
    ARQAQQLLLK

151 GLSFEGLMKR YPNDEQAFDG FIMAQQLPEP LASQFAAMNR
    GDVTRDPVKL

201 GERYYLFKLS EVGKNPDAQP FELVRNQLEQ GLRQEKARLK
    IDAILEENGV

251 KP*
```

ORF76a and ORF76-1 show 97.6% identity in 252 aa overlap:

```
             10         20         30         40         50         60
orf76a.pep   MKQKKTAAAVIAAMLAGFAAAKAPEIDPALVDTLVAQIMQQADRHAEQSQKPDQAIRND
             ||||||||||||||||||||||||||||||||||||||||||||||||||||||||||
orf76-1      MKQKKTAAAVIAAMLAGFAAAKAPEIDPALVDTLVAQIMQQADRHAEQSQKPDQAIRND
             10         20         30         40         50         60
             70         80         90        100        110        120
orf76a.pep   AVRRLQTLEVLKNRALKEGLDKDKDVQNRFKIAEASFYAEEYVRFLERSETVSESAERQF
             ||||||||||||||||||||||||||||||||||||||||||||||||||||| |::|
orf76-1      AVRRLQTLEVLKNRALKEGLDKDKDVQNRFKIAEASFYAEEYVRFLERSETVSEDEEHKF
             70         80         90        100        110        120
             130        140        150        160        170        180
orf76a.pep   YERQIRMIKLQQVSFATEEEARQAQQLLLKGLSFEGLMKRYPNDEQAFDGFIMAQQLPEP
             ||:|||||||||||||||||||||||||||||||||||||||||||||||||||||||
orf76-1      YEQQIRMIKLQQVSFATEEEARQAQQLLLKGLSFEGLMKRYPNDEQAFDGFIMAQQLPEP
             130        140        150        160        170        180
             190        200        210        220        230        240
orf76a.pep   LASQFAAMNRGDVTRDPVKLGERYYLFKLSEVGKNPDAQPFFLVRNQLEQGLRQEKARLK
             ||||||||||||||||||||||||||||||||||||||||||||||||||||||||||
orf76-1      LASQFAAMNRGDVTRDPVKLGERYYLFKLSEVGKNPDAQPFFLVRNQLEQGLRQEKARLK
             190        200        210        220        230        240
             250
orf76a.pep   IDAILEENGVKPX
             |||:|||||||||
orf76-1      IDALLEENGVKPX
             250
```

Homology with a Predicted ORF from *N. gonorrhoeae*

The aligned aa sequences of ORF76 and a predicted ORF (ORF76.ng) from *N. gonorrhoeae* of the N- and C-termini show 96.7% and 100% identity in 30 and 31 overlap, respectively:

```
orf76.pep   MKQKKTAAAVIAAMLAGFAAXKAPEIDPAL                                              30
            ||||||||||||||||||| ||||||||
orf76ng     MKQKKTAAAVIAAMLAGFAAAKAPEIDPALVDTLVAQIMQQADRHAEQSQRPDGQAIRND                60
                                        //
orf76.pep                              ELVRNQLEQGLRQEKARLKIDALLEENGVKP             251
                                       |||||||||||||||||||||||||||||||
orf76ng     VTRNPVKLGERYYLFKLGAVGKNPDAQPFELVRNQLEQGLRQEKARLKIDALLEENGVKP            251
```

The complete length ORF76ng nucleotide sequence <SEQ ID 301> is:

```
  1  ATGAAACAGA AAAAGACCGC TGCCGCAGTT ATTGCTGCAA TGTTGGCAGG

51  TTTTGCGGCA GCCAAAGCAC CCGAAATCGA CCCGGCTTTG GTGGATACGC

101  TGGTGGCGCA GATCATGCAG CAGGCAGACC GGCATGCGGA GCAGTCCCAA

151  AGACCGGACG GCAGGCAAT CCGAAACGAT GCCGTCCGCC GGCTGCAAAC

201  TTTGGAAGTT TTGAAAAACA GGGCATTGAA GGAAGGTTTG GATAAGGATA

251  AGGATGTCCA AAACCGCTTT AAAATCGCCG AAGCGTCTTT TTATGCCGAG

301  GAGTACGTCC GTTTTCTGGA ACGTTCGGAA ACGGTTCCG AAACCGCACT

351  GCGTCAGTTT TATGAGCGGC AAATCCGCAT GATCAAATTG CAGCAGGTCA
```

-continued

```
401 GCTTCGCAAC CGAAGAGGAG GCGCGTCAGG CGCAGCAGCT CCTGCTCAAA
451 GGGCTGTCTT TTGAAGGGCT GATGAAGCGT TATCCGAACG ACGAGCAGGC
501 GTTCGACGGT TTCATTATGG CGCAGCAGCT CCCCGAGCCG CTGCCTTcgc
551 agtttgCCGG TATGAACCGT GGCGACGTTA CCCGCAATCC GGTCAAATTG
601 GGCGAACGCT ATTACCTGTT CAAACTCGGC GCGGTCGGGA AAAACCCCGA
651 CGCGCAGCCT TTCGAGTTGG TCAGAAACCA GTTGGAACAA GGTTTGAGGC
701 AGGAAAAAGC CCGCTTGAAA ATCGATGCCC TTTTGGAaga Aaacggtgtc
751 AaacCGTAA
```

This encodes a protein having amino acid sequence <SEQ ID 302>:

```
  1 MKQKKTAAAV IAAMLAGFAA AKAPEIDPAL VDTLVAQIMQ QADRHAEQSQ
 51 RPDGQAIRND AVRRLQTLEV LKNRALKEGL DKDKDVQNRF KIAEASFYAE
101 EYVRFLERSE TVSESALRQF YERQIRMIKL QQVSFATEEE ARQAQQLLLK
151 GLSFEGLMKR YPNDEQAFDG FIMAQQLPEP LASQFAGMNR GDVTRNPVKL
201 GERYYLFKLG AVGKNPDAQP FELVRNQLEQ GLRQEKARLK IDALLEENGV
251 KP*
```

ORF76ng and ORF76-1 show 96.0% identity in 252 aa overlap

```
                    10         20         30         40         50         60
    orf76-1.pep  MKQKKTAAAVIAAMLAGFAAAKAPEIDPALVDTLVAQIMQQADRHAEQSQKPDGQAIRND
                 ||||||||||||||||||||||||||||||||||||||||||||||||||:|||||||||
    orf76ng      MKQKKTAAAVIAAMLAGFAAAKAPEIDPALVDTLVAQIMQQADRHAEQSQRPDGQAIRND
                    10         20         30         40         50         60

70         80         90        100        110        120
    orf76-1.pep  AVRRLQTLEVLKNRALKEGLDKDKDVQNRFKIAEASFYAEEYVRFLERSETVSEDELHKF
                 |||||||||||||||||||||||||||||||||||||||||||||||||||||:|::|
    orf76ng      AVRRLQTLEVLKNRALKEGLDKDKDVQNRFKIAEASFYAEEYVRFLERSETVSESALRQF
                    70         80         90        100        110        120

130        140        150        160        170        180
    orf76-1.pep  YEQQIRMIKLQQVSFATEEEARQAQQLLLKGLSFEGLMKRYPNDEQAFDGFIMAQQLPEP
                 ||:|||||||||||||||||||||||||||||||||||||||||||||||||||||||||
    orf76ng      YERQIRMIKLQQVSFATEEEARQAQQLLLKGLSFEGLMKRYPNDEQAFDGFIMAQQLPEP
                   130        140        150        160        170        180

190        200        210        220        230        240
    orf76-1.pep  LASQFAAMNRGDVTRDPVKLGERYYLFKLSEVGKNPDAQPFELVRNQLEQGLRQEKARLK
                 ||||||:|||||||:||||||||||||||:||||||||||||||||||||||||||||||
    orf76ng      LASQFAGMNRGDVTRNPVKLGERYYLFKLGAVGKNPDAQPFELVRNQLEQGLRQEKARLK
                   190        200        210        220        230        240

250
    orf76-1.pep  IDALLEENGVKPX
                 |||||||||||||
    orf76ng      IDALLEENGVKPX
                   250
```

Furthermore, ORF76ng shows significant homology to a B. subtilis export protein precursor:

```
sp|P24327|PRSA_BACSU PROTEIN EXPORT PROTEIN PRSA PRECURSOR >gi|98227|
pir| |S15269
33 K lipoprotein - Bacillus subtilis >gi|39782 (X57271) 33 kDa lipoprotein
[Bacillus subtilis]
>gi|2226124|gnl|PID|e325181 (Y14077) 33 kDa lipoprotein [Bacillus subtilis]
>gi|2633331|gnl|PID|e1182997 (Z99109) molecular chaperonin [Bacillus subtilis]
Length = 292
Score = 50.4 bits (118), Expect = 1e-05
Identities = 48/199 (24%), Positives = 82/199 (41%), Gaps = 32/199 (16%)

Query: 70   VLKNRALKEGLDK-----DKDVQNRFKIAEASF----------YAEEYVRFLERSETVSE 114
            VL    ++ LDK     DK++ N+ K  +           Y ++Y++   + E +++
Sbjct: 53   VLTQLVQEKVLDKKYKVSDKEIDNKLKEYKTQLGDQYTALEKQYGKDYLKEQVKYELLTQ 112

Query: 115  SA-----------LRQFYERQIRMIKLQQVSFATEEEARQAQQLLLKGLSFEGLMKRYPN 163
             A           +++++E      I+   +  A ++ A + ++ L  KG   FE L K Y
Sbjct: 113  KAAKDNIKVTDADIKEYWEGLKGKIRASHILVADKKTAEEVEKKLKKGEKFEDLAKEYST 172

Query: 164  DEQAFDG-----FIMAQQLPEPLASQFAAMNRGDVTRDPVKLGERYYLFKLSEVGKNPDA 218
            D  A G      F    Q+ E  +    +  G+V+ DPVK    Y++ K +E       D
Sbjct: 173  DSSASKGGDLGWFAKEGQMDETFSKAAFKLKTGEVS-DPVKTQYGYHIIKKTEERGKYDD 231

Query: 219  QPFELVRNQLEQGLRQEKA 237
               EL    LEQ L   A
Sbjct: 232  MKKELKSEVLEQKLNDNAA 250
```

Based on this analysis, including the presence of a putative leader sequence and a RGD motif in the gonococcal protein, it was predicted that the proteins from N. meningitidis and N. gonorrhoeae, and their epitopes, could be useful antigens for vaccines or diagnostics, or for raising antibodies.

ORF76-1 (27.8 kDa) was cloned in the pET vector and expressed in E. coli, as described above. The products of protein expression and purification were analyzed by SDS-PAGE. FIG. 10A shows the results of affinity purification of the His-fusion protein, Purified His-fusion protein was used to immunise mice, whose sera were used for Western blot (FIG. 10B), ELISA (positive result), and FACS analysis (FIG. 10C). These experiments confirm that ORF76-1 is a surface-exposed protein, and that it is a useful immunogen.

Example 36

The following partial DNA sequence was identified in N. meningitidis <SEQ ID 303>:

```
   1  ATGAAAAAAT CTTTCCTTAC GCTTGTTCTG TATTCGTCTT TACTTACCGC
  51  CAGCGAAATT GCCTTACCCC TTGGAATTGG GGATTGAAAC CTTACCGGCG
 101  GCAAAAATTG CGGAAACGTT TGCGCTGACA TTTGTGATTG CTGCGCTGTA
 151  TCTGTTTGCG CGTAATAAGG TGACGCGTTT GTTGATTGCG GTGTTTTTTG
 201  CGTTCAGCAT TATTGCCAAC AATGTGCATT ACGCGGATTA TCAAAGCTGG
 251  ATGACG....  ........ ........ ........ ........
                                    //
1201  ......... CAAACCGTAT TCGAGCAGCT GCAAAAGACT CCTGACGGCA
1251  ACTGGCTGTT TGCCTATACC TCCGATCATG GCCAGTATGT TCGCCAAGAT
1301  ATCTACAATC AAGGCACGGT GCAGCCCGAC AGCTATCTCG TGCCGCTAGT
1351  GTTGTACAGC CCGGATAAGG CCGTGCAACA GGCTGCCAAC CAGGCTTTTG
1401  CGCCTTGCGA GATTGCCTTC CATCAGCAGC TTTCAACGTT CCTGATTCAC
1451  ACGTTGGGCT ACGATATGCC GGTTTCAGGT TGTCGCGAAG GCTCGGTAAC
1501  GGGCAACCTG ATTACGGGTG ATGCAGGCAG CTTGAACATT CGCGACGGCA
1551  AGGCGGAATA TGTTTATCCG CAATGA
```

This corresponds to the amino acid sequence <SEQ ID 304; ORF81>:

```
  1  MKKSFLTLVL YSSLLTASEI AYPLELGIET LPAAKIAETF ALTFVIAALY

51  LFARNKVTRL LIAVFFAFSI IANNVHYADY QSWMT..... ..........
                                //

401  ...QTVFEQL QKTPDGNWLF AYTSDHGQYV RQDIYNQGTV QPDSYLVPLV

451  LYSPDKAVQQ AANQAFAPCE IAFHQQLSTF LIHTLGYDMP VSGCREGSVT

501  GNLITGDAGS LNIRDGKAEY VYPQ*
```

Further work revealed the complete nucleotide sequence <SEQ ID 305>:

```
   1  ATGAAAAAAT CTTTCCTTAC GCTTGTTCTG TATTCGTCTT TACTTACCGC

51  CAGCGAAATT GCCTATCGCT TTGTATTTGG GATTCAAACC TTACCGGCGG

101  CAAAAATTGC GGAAACGTTT GCGCTGACAT TTGTGATTGC TGCGCTGTAT

151  CTGTTTGCGC GTTATAAGGT GACGCGTTTG TTGATTGCGG TGTTTTTTGC

201  GTTCAGCATT ATTGCCAACA ATGTGCATTA CGCGGTTTAT CAAAGCTGGA

251  TGACGGGCAT CAATTATTGG CTGATGCTGA AGAGGTTAC CGAAGTCGGC

301  AGCGCGGGTG CGTCGATGTT GGATAAGTTG TGGCTGCCTG TGTTGTGGGG

351  CGTGTTGGAA GTCATGTTGT TTTGCAGCCT TGCCAAGTTC CGCCGTAAGA

401  CGCATTTTTC TGCCGATATA CTGTTTGCCT TCCTAATGCT GATGATTTTC

451  GTGCGTTCGT TCGACACGAA ACAAGAGCAC GGTATTTCGC CCAAACCGAC

501  ATACAGCCGC ATCAAAGCCA ATTATTTCAG CTTCGGTTAT TTTGTCGGAC

551  GCGTGTTGCC GTATCAGTTG TTTGATTTAA GCAGGATTCC CGCCTTTAAG

601  CAGCCTGCTC CAAGCAAAAT CGGGCAGGGC AGTGTTCAAA ATATCGTCCT

651  GATTATGGGC GAAAGCGAAA GCGCGGCGCA TTTGAAGCTG TTTGGCTACG

701  GACGCGAAAC TTCGCCGTTT TTAACCCGGC TGTCGCAAGC CGATTTTAAG

751  CCGATTGTGA AACAAGTTA TTCCGCAGGC TTTATGACTG CAGTGTCCCT

801  GCCCAGTTTT TTCAATGCGA TACCGCACGC CAACGGCTTG GAACAAATCA

851  GCGGCGGCGA TACCAATATG TTCCGCCTCG CCAAAGAGCA GGGCTATGAA

901  ACGTATTTTT ACAGCGCGCA GGCGGAAAAC GAGATGGCGA TTTTGAACTT

951  AATCGGTAAG AAATGGATAG ACCATCTGAT TCAGCCGACG CAACTTGGCT

1001  ACGGCAACGG CGACAATATG CCCGATGAGA AGCTGCTGCC GTTGTTCGAC

1051  AAAATCAATT TGCAGCAGGG CAAGCATTTT ATCGTGTTGC ACCAACGCGG

1101  TTCGCACGCC CCATACGGCG CATTGTTGCA GCCTCAAGAT AAAGTATTCG

1151  GCGAAGCCGA TATTGTGGAT AAGTACGACA ACACCATCCA CAAAACCGAC

1201  CAAATGATTC AAACCGTATT CGAGCAGCTG CAAAAGCAGC CTGACGGCAA

1251  CTGGCTGTTT GCCTATACCT CCGATCATGG CCAGTATGTT CGCCAAGATA

1301  TCTACAATCA AGGCACGGTG CAGCCCGACA GCTATCTCGT GCCGCTAGTG

1351  TTGTACAGCC CGGATAAGGC CGTGCAACAG CTGCCAACC AGGCTTTTGC

1401  GCCTTGCGAG ATTGCCTTCC ATCAGCAGCT TTCAACGTTC CTGATTCACA

1451  CGTTGGGCTA CGATATGCCG GTTTCAGGTT GTCGCGAAGG CTCGGTAACG
```

-continued

```
1501  GGCAACCTGA TTACGGGTGA TGCAGGCAGC TTGAACATTC GCGACGGCAA
1551  CGCGGAATAT GTTTATCCGC AATGA
```

This corresponds to the amino acid sequence <SEQ ID 306; ORF81-1>:

```
  1  MKKSFLTLVL YSSLLTASEI AYRFVFGIET LPAAKIAETF ALTFVIAALY
 51  LFARYKVTRL LIAVFFAFST IANNVHYAVY QSWMTGINYW LMLKEVTEVG
101  SAGASMLDKL WLPVLWGVLE VMLFCSLAKF RRKTHFSADI LFAFLMLMIF
151  VRSFDTKQEH GISPKPTYSR IKANYFSFGY FVGRVLPYQL FDLSRIPAFK
201  QPAPSKIGQG SVQNIVLIMG ESESAAHLKL FGYGRETSPF LTRLSQADFK
251  PIVKQSYSAG FMTAVSLFSF FNAIPHANGL EQISGGDTNM FRLAKEQGYE
301  TYFYSAQAEN EMAILNLIGK KWIDHLIQPT QLGYGNGDNM PDEKLLPLFD
351  KINLQQGKHF IVLHQRGSHA PYGALLQPQD KVFGEADIVD KYDNTIHKTD
401  QMIQTVFEQL QKQPDGNWLF AYTSDHGQYV RQDIYNQGTV QPDSYLVPLV
451  LYSPDKAVQQ AANQAFAPCE IAFHQQLSTF LIHTLGYDMP VSGCREGSVT
501  GNLITGDAGS LNIRDGKAEY VYPQ*
```

Computer analysis of this amino acid sequence gave the following results:
Homology with a Predicted ORF from *N. meningitidis* (Strain A)

ORF81 shows 84.7% identity over a 85aa overlap and 99.2% identity over a 121aa overlap with an ORF (ORF81a) from strain A of *N. meningitidis*:

```
                        10         20         30         40         50         60
  orf81.pep    MKKSFLTLVLYSSLLTASEIAYPLELGIETLPAAKIAETFALTFVIAALYLFARNKVTRL
               ||||:::|||||||||||||| :|||||||||:||||||||||||||||||||| |:|||
  orf81a       MKKSLFVLFLYSSLLTASEIAYRFVFGIETLPAAKMAETFALTFVIAALYLFARYKATRL
                        10         20         30         40         50         60

70         80
  orf81.pep    LIAVFFAFSIIANNVHYADYQSWMT
               |||||||||||||||||  ||||:|
  orf81a       LIAVFFAFSIIANNVHYAVYQSWITGINYWLMLKEITEVGGAGASMDKLWLPALWGVLE
                        70         80         90        100        110        120

//

120        130        140
  orf81.pep                         QTVFEQLQKTPDGNWLFAYTSDHGQYVRQD
                                    |||||||| ||||||||||||||||||||
  orf81a       IPHANGLEQISGGDIVDKYDNTIHKTDQMIQTVFEQLQKQPDGNWLFAYTSDHGQYVRQD
                        280        290        300        310        320        330

150        160        170        180        190        200
  orf81.pep    IYNQGTVQPDSYLVPLVLYSPDKAVQQAANQAFAPCEIAFHQQLSTFLIHTLGYDMPVSG
               ||||||||||||||||||||||||||||||||||||||||||||||||||||||||||||
  orf81a       IYNQGTVQPDSYLVPLVLYSPDKAVQQAANQAFAPCEIAFHQQLSTFLIHTLGYDMPVSG
                        340        350        360        370        380        390

210        220        230
  orf81.pep    CREGSVTGNLITGDAGSLNIRDGKAEYVYPQX
               ||||||||||||||||||||||||||||||||
  orf81a       CREGSVTGNLITGDAGSLNIRDGKAEYVYPQX
                        400        410        420
```

The complete length ORF81a nucleotide sequence <SEQ ID 307> is:

```
   1  ATGAAAAAAT CCCTTTTCGT TCTCTTTCTG TATTCCTCCC TACTTACTGC
  51  CAGCGAAATT GCTTATCGCT TTGTATTCGG AATTGAAACC TTACCGGCTG
 101  CAAAAATGGC AGAAACGTTT GCGCTGACAT TTGTGATTGC TGCGCTGTAT
 151  CTGTTTGCGC GTTATAAGGC AACGCCTTTG TTGATTGCGG TGTTTTTCGC
 201  GTTCAGCATT ATTGCCAACA ATGTGCATTA CGCGGTTTAT CAAAGCTGGA
 251  TAACGGGCAT TAATTATTGG CTGATGCTGA AAGAGATTAC CGAAGTTGGC
 301  GGCGCAGGGG CGTCGATGTT GGATAAGTTG TGGCTGCCTG CGTTGTGGGG
 351  CGTGTTGGAA GTCATGTTGT TTTGCAGCCT TGCCAAGTTC CGCCGTAAGA
 401  CGCATTTTTC TGCCGATATA CTGTTTGCCT TCCTAATGCT GATGATTTTC
 451  GTGCGTTCGT TCGACACGAA ACAAGAACAC GGTATTTCGC CCAAACCGAC
 501  ATACAGCCGC ATCAAAGCCA ATTATTTCAG CTTCGGTTAT TTTGTCGGAC
 551  GCGTGTTGCC GTATCAGTTG TTTGATTTAA GCAAGATTCC TGTGTTCAAA
 601  CAGCCTGCTC CAAGCAGAAT CGGGCAAGGC AGTATTCAAA ATATCGTCCT
 651  GATTATGGGC GAAAGCGAAA GCGCGGCGCA TTTGAAATTG TTTGGCTACG
 701  GCGCGAAAC TTCGCCGTTT TTGACCCAGC TTTCGCAAGC CGATTTTAAG
 751  CCGATTGTGA AACAAAGTTA TTCCGCAGGC TTTATGACGG CAGTATCCCT
 801  GCCCAGTTTC TTTAACGTCA TACCGCATGC CAACGGCTTG AACAAATCA
 851  GCGGCGGCGA TATTGTGGAT AAGTACGACA ACACCATCCA CAAAACCGAC
 901  CAAATGATTC AAACCGTATT CGAGCAGCTG CAAAAGCAGC CTGACGGCAA
 951  CTGGCTGTTT CCCTATACCT CCCATCATGG CCAGTATGTT CGCCAACATA
1001  TCTACAATCA AGGCACGGTG CAGCCCGACA GCTATCTCGT GCCGCTGGTG
1051  TTGTACAGCC CGGATAAGGC CGTCCAACAG GCTGCCAACC ACGCTTTTGC
1101  GCCTTGCGAG ATTGCCTTCC ATCAGCAGCT TTCAACGTTC CTGATTCACA
1151  CGTTGGGCTA CGATATGCCG GTTTCAGGTT GTCGCGAAGG CTCGGTAACG
1201  GGCAACCTGA TTACGGGTGA TGCAGGCAGC TTGAACATTC GCGACGGCAA
1251  GGCGGAATAT GTTTATCCGC AATGA
```

This encodes a protein having amino acid sequence <SEQ ID 308>:

```
  1  MKKSLFVLFL YSSLLTASEI AYRFVFGIET LPAAKMAETF ALTFVIAALY
 51  LFARYKATRL LIAVFFAFSI IANNVHYAVY QSWITGINYW LMLKEITEVG
101  GAGASMLDKL WLPALWGVLE VMLFCSLAKF RRKTHFSADI LFAFLMLMIF
151  VRSFDTKQEH GISPKPTYSR IKANYFSFGY FVGRVLPYQL FDLSKIPVFK
201  QPAPSRIGQG SIQNIVLIMG ESESAAHLKL FGYGRETSPF LTQLSQADFK
251  PIVKQSYSAG FMTAVSLPSF FNVIPHANGL EQISGGDIVD KYDNTIHKTD
301  QMIQTVFEQL QKQPDGNWLF AYTSDHGQYV RQDIYNQGTV QPDSYLVPLV
351  LYSPDKAVQQ AANQAFAPCE IAFHQQLSTF LIHTLGYDMP VSGCREGSVT
401  GNLITGDAGS LNIRDGKAEY VYPQ*
```

ORF81a and ORF81-1 show 77.9% identity in 524 aa overlap:

```
                  10        20        30        40        50        60
orf81a.pep   MKKSLFVLFLYSSLLTASEIAYRFVFGIETLPAAKMAETFALTFVIAALYLFARYKATRL
             ||||:::||||||||||||||||||||||||||||:||||||||||||||||||||:|||
orf81-1      MKKSFLTLVLYSSLLTASEIAYRFVFGIETLPAAKIAETFALTFVIAALYLFARYKVTRL
                  10        20        30        40        50        60

70        80        90       100       110       120
orf81a.pep   LIAVFFAFSIIANNVHYAVYQSWITGINYWLMLKEITEVGGAGASMLDKLWLPALWGVLE
             |||||||||||||||||||||||:||||||||||:||||:||||||||||||:|||||
orf81-1      LIAVFFAFSIIANNVHYAVYQSWMTGINYWLMLKEVTEVGSAGASMLDKLWLPVLWGVLE
                  70        80        90       100       110       120

130       140       150       160       170       180
orf81a.pep   VMLFCSLAKFRRKTHFSADILFAFLMLMIFVRSFDTKQEHGISPKPTYSRIKANYFSFGY
             ||||||||||||||||||||||||||||||||||||||||||||||||||||||||||||
orf81-1      VMLFCSLAKFRRKTHFSADILFAFLMLMIFVRSFDTKQEHGISPKPTYSRIKANYFSFGY
                 130       140       150       160       170       180

190       200       210       220       230       240
orf81a.pep   FVGRVLPYQLFDLSKIPVFKQPAPSRIGQGSIQNIVLIMGESESAAHLKLFGYGRETSPF
             ||||||||||||:||:|||||||:|||||:||||||||||||||||||||||||||||
orf81-1      FVGRVLPYQLFDLSRIPAFKQPAPSKIGQGSVQNIVLIMGESESAAHLKLFGYGRETSPF
                 190       200       210       220       230       240

250       260       270       280
orf81a.pep   LTQLSQADFKPIVKQSYSAGFMTAVSLPSFFNVIPHANGLEQISGGD-------------
             ||:||||||||||||||||||||||||||||:|||||||||||||
orf81-1      LTRLSQADFKPIVKQSYSAGFMTAVSLPSFFNAIPHANGLEQISGGDTNMFRLAKEQGYE
                 250       260       270       280       290       300 orf81a.pep   ------------------------------------------------------------ orf81-1      TYFYSAQAENEMAILNLIGKKWIDHLIQPTQLGYGNGDNMPDEKLLPLFDKINLQQGKHF
                 310       320       330       340       350       360

290       300       310       320
orf81a.pep   -------------------------IVDKYDNTIHKTDQMIQTVFEQLQKQPDGNWLF
                                      ||||||||||||||||||||||||||||||||||
orf81-1      IVLHQRGSHAPYGALLQPQDKVFGEADIVDKYDNTIHKTDQMIQTVFEQLQKQPDGNWLF
                 370       380       390       400       410       420

330       340       350       360       370       380
orf81a.pep   AYTSDHGQYVRQDIYNQGTVQPDSYLVPLVLYSPDKAVQQAANQAFAPCEIAFHQQLSTF
             ||||||||||||||||||||||||||||||||||||||||||||||||||||||||||||
orf81-1      AYTSDHGQYVRQDIYNQGTVQPDSYLVPLVLYSPDKAVQQAANQAFAPCEIAFHQQLSTF
                 430       440       450       460       470       480

390       400       410       420
orf81a.pep   LIHTLGYDMPVSGCREGSVTGNLITGDAGSLNIRDGKAEYVYPQX
             |||||||||||||||||||||||||||||||||||||||||||||
orf81-1      LIHTLGYDMPVSGCREGSVTGNLITGDAGSLNIRDGKAEYVYPQX
                 490       500       510       520
```

Homology with a Predicted ORF from *N. gonorrhoeae*

The aligned aa sequences of ORF81 and a predicted ORF (ORF81.ng) from *N. gonorrhoeae* of the N- and C-termini show 82.4% and 97.5% identity in 85 and 121 overlap, respectively:

```
orf81.pep   MKKSFLTLVLYSSLLTASEIAYPLELGIETLPAAKIAETFALTFVIAALYLFARNKVTRL   60
            ||||:::|||||||||||||||:|:|||||||||||||||||||||||||||||:|::||
orf81ng     MKKSLFVLFLYSSLLTASEIAYRFVFGIETLPAAKMAETFALTFMIAALYLFARYKASRL   60
```

```
orf81.pep  LIAVFFAFSIIANNVHYADYQSWMT                                        85
           ||||||||| ||||||||| ||||||
orf81ng    LIAVFFAFSMIANNVHYAVYQSWMTGINYWLMLKEVTEVGSAGASMLDKLWLPALWGVAE     120
                                     //
orf81.pep                                      QTVFEQLQKTPDGNWLFAYTSDHGQYVRQD   433
                                               ||||||||| ||||||||||||||||||||||
orf81ng    ALLQPQDKVFGEADIVDKYDNTIHKTDQMIQTVFEQLQKQPDGNWLFAYTSDHGQYVRQD     433
orf81.pep  IYNQGTVQPDSYLVPLVLYSPDKAVQQAANQAFAPCEIAFHQQLSTFLIHTLGYDMPVSG     493
           |||||||||||| |||||||||||||||||||||||||||||||||||||||||||||||
orf81ng    IYNQGTVQPDSYIVPLVLYSPDKAVQQAANQAFAPCEIAFHQQLSTFLIHTLGYDMPVSG     493
orf81.pep  CREGSVTGNLITGDAGSLNIRDGKAEYVYPQ              524
           |||||||||||||||||||||||| |||||||
orf81ng    CREGSVTGNLITGDAGSLNIRNGKAEYVYPQ              524
```

The complete length ORF81ng nucleotide sequence <SEQ ID 309> is:

```
   1 ATGAAAAAAT CCCTTTTCGT TCTCTTTCTG TATTCATCCC TACTTACCGC
  51 CAGCGAAATC GCCTATCGCT TTGTATTCGG AATTGAAACC TTACCGGCTG
 101 CAAAAATGGC GGAAACGTTT GCGCTGACAT TATGATTGC TGCGCTGTAT
 151 CTGTTTGCGC GTTATAAGGC TTCGCGGCTG CTGATTGCGG TGTTTTTCGC
 201 CTTCAGCATG ATTGCCAACA ATGTGCATTA CGCGGTTTAT CAAAGCTGGA
 251 TGACGGGTAT TAACTATTGG CTGATGCTGA AAGAGGTTAC CGAAGTCGGC
 301 AGCGCGGGCG CGTCGATGTT GGATAAGTTG TGGCTGCCTG CTTTGTGGGG
 351 CGTGGCGGAA GTCATGTTGT TTTGCAGCCT TGCCAAGTTC CGCCGTAAGA
 401 CGCATTTTTC TGCCGATATA CTGTTTGCCT TCCTAATGCT GATGATTTTC
 451 GTGCGTTCGT TCGACACGAA ACAAGAGCAC GGTATTTCGC CCAAACCGAC
 501 ATACAGCCGC ATCAAAGCCA ATTATTTCAG CTTCGGTTAT TTTGTCGGGC
 551 GCGTGTTGCC GTATCAGTTG TTTGATTTAA GCAAGATCCC TGTGTTCAAA
 601 CAGCCTGCTC AAGCAAAAT CGGGCAAGGC AGTATTCAAA ATATCGTCCT
 651 GATTATGGGC GAAAGCGAAA GCGCGGCGCA TTTGAAATTG TTTGGTTACG
 701 GGCGCGAAAC TTCGCCGTTT TTAACCCGGC TGTCGCAAGC CGATTTTAAG
 751 CCGATTGTGA AACAAAGTTA TTCCGCAGGC TTTATGACGG CAGTATCCCT
 801 GCCCAGTTTC TTTAACGTCA TACCGCACGC CAACGGCTTG AACAAATCA
 851 GCGGCGGCGA TACCAATATG TTCCGCCTCG CCAAAGAGCA GGGCTATGAA
 901 ACGTATTTTT ACAGTGCCCA GGCTGAAAAC CAAATGGCAA TTTTGAACTT
 951 AATCGGTAAG AAATGGATAG ACCATCTGAT TCAGCCGACG CAACTTGGCT
1001 ACGGCAACGG CGACAATATG CCCGATGAGA AGCTGCTGCC GTTGTTCGAC
1051 AAAATCAATT TGCAGCAGGG CAGGCATTTT ATCGTGTTGC ACCAACGCGG
1101 TTCGCACGCC CCATACGGCG CATTGTTGCA GCCTCAAGAT AAAGTATTCG
1151 GCGAAGCCGA TATTGTGGAT AAGTACGACA ACACCATCCA CAAAACCGAC
1201 CAAATGATTC AAACCGTATT CGAGCAGCTG CAAAAGCAGC CTGACGGCAA
1251 CTGGCTGTTT GCCTATACCT CCGATCATGG CCAGTATGTG CGCCAAGATA
```

```
-continued
1301 TCTACAATCA AGGCACGGTG CAGCCCGACA GCTATATTGT GCCTCTGGTT

1351 TTGTACAGCC CGGATAAGGC CGTGCAACAG GCTGCCAACC AGGCTTTTGC

1401 GCCTTGCGAG ATTGCCTTCC ATCAGCAGCT TTCAACGTTC CTGATTCACA

1451 CGTTGGGCTA CGATATGCCG GTTTCAGGTT GTCGCGAAGG CTCGGTAACA

1501 GGCAACCTGA TTACGGGCGA TGCAGGCAGC TTGAACATTC GCAACGGCAA

1551 GGCGGAATAT GTTTATCCGC AATAA
```

This encodes a protein having amino acid sequence <SEQ ID 310>:

```
  1 MKKSLFVLFL YSSLLTASEI AYRFVFGIET LPAAKMAETF ALTFMIAALY

51 LFARYKASRL LIAVFFAFSM IANNVHYAVY QSWMTGINYW LMLKEVTEVG

101 SAGASMLDKL WLPALWGVAE VMLFCSLAKF RRKTHFSADI LFAFLMLMIF

151 VRSFDTKQEH GISPKPTYSR IKANYFSFGY FVGRVLPYQL FDLSKIPVFK

201 QPAPSKIGQG SIQNIVLIMG ESESAAHLKL FGYGRETSPF LTRLSQADFK

251 PIVKQSYSAG FMTAVSLPSF FNVIPHANGL EQISGGDTNM FRLAKEQGYE

301 TYFYSAQAEN QMAILNLIGK KWIDHLIQPT QLGYGNGDNM PDEKLLPLFD

351 KINLQQGRHF IVLHQRGSHA PYGALLQPQD KVFGEADIVD KYDNTIHKTD

401 QMIQTVFEQL QKQPDGNWLF AYTSDHGQYV RQDIYNQGTV QPDSYIVPLV

451 LYSPDKAVQQ AANQAFAPCE IAFHQQLSTF LIHTLGYDMP VSGCREGSVT

501 GNLITGDAGS LNIRNGKAEY VYPQ*
```

ORF81ng and ORF81-1 show 96.4% identity in 524 aa overlap:

```
                   10         20         30         40         50         60
orf81ng-1.pep  MKKSLFVLFLYSSLLTASEIAYRFVFGIETLPAAKMAETFALTFMIAALYLFARYKASRL
               ||||:::| ||||||||||||||||||||||||||||:||||||||:||||||||||::||
orf81-1        MKKSFLTLVLYSSLLTASEIAYRFVFGIETLPAAKIAETFALTFVIAALYLFARYKVTRL
                   10         20         30         40         50         60

70         80         90        100        110        120
orf81ng-1.pep  LIAVFFAFSMIANNVHYAVYQSWMTGINYWLMLKEVTEVGSAGASMLDKLWLPALWGVAE
               ||||||||||:|||||||||||||||||||||||||||||||||||||||||:||| |
orf81-1        LIAVFFAFSIIANNVHYAVYQSWMTGINYWLMLKEVTEVGSAGASMLDKLWLPVLWGVLE
                   70         80         90        100        110        120

130        140        150        160        170        180
orf81ng-1.pep  VMLFCSLAKFRRKTHFSADILFAFLMLMIFVRSFDTKQEHGISPKPTYSRIKANYFSFGY
               ||||||||||||||||||||||||||||||||||||||||||||||||||||||||||||
orf81-1        VMLFCSLAKFRRKTHFSADILFAFLMLMIFVRSFDTKQEHGISPKPTYSRIKANYFSFGY
                  130        140        150        160        170        180

190        200        210        220        230        240
orf81ng-1.pep  FVGRVLPYQLFDLSKIPVFKQPAPSKIGQGSIQNIVLIMGESESAAHLKLFGYGRETSPF
               ||||||||||||||:||:||||||||||||:|||||||||||||||||||||||||||||
orf81-1        FVGRVLPYQLFDLSRIPAFKQPAPSKIGQGSVQNIVLIMGESESAAHLKLFGYGRETSPF
                  190        200        210        220        230        240

250        260        270        280        290        300
orf81ng-1.pep  LTRLSQADFKPIVKQSYSAGFMTAVSLPSFFNVIPHANGLEQISGGDTNMFRLAKEQGYE
               ||||||||||||||||||||||||||||||||:|||||||||||||||||||||||||||
orf81-1        LTRLSQADFKPIVKQSYSAGFMTAVSLPSFFNAIPHANGLEQISGGDTNMFRLAKEQGYE
                  250        260        270        280        290        300

310        320        330        340        350        360
orf81ng-1.pep  TYFYSAQAENQMAILNLIGKKWIDHLIQPTQLGYGNGDNMPDEKLLPLFDKINLQQGRHF
               ||||||||||:|||||||||||||||||||||||||||||||||||||||||||||||:||
orf81-1        TYFYSAQAENEMAILNLIGKKWIDHLIQPTQLGYGNGDNMPDEKLLPLFDKINLQQGKHF
                  310        320        330        340        350        360
```

```
                  370        380        390        400        410        420
orf81ng-1.pep  IVLHQRGSHAPYGALLQPQDKVFGEADIVDKYDNTIHKTDQMIQTVFEQLQKQPDGNWLF
               ||||||||||||||||||||||||||||||||||||||||||||||||||||||||||||
orf81-1        IVLHQRGSHAPYGALLQPQDKVFGEADIVDKYDNTIHKTDQMIQTVFEQLQKQPDGNWLF
                  370        380        390        400        410        420

430        440        450        460        470        480
orf81ng-1.pep  AYTSDHGQYVRQDIYNQGTVQPDSYIVPLVLYSPDKAVQQAANQAFAPCEIAFHQQLSTF
               |||||||||||||||||||||||||||||:||||||||||||||||||||||||||||||
orf81-1        AYTSDHGQYVRQDIYNQGTVQPDSYLVPLVLYSPDKAVQQAANQAFAPCEIAFHQQLSTF
                  430        440        450        460        470        480

490        500        510        520
orf81ng-1.pep  LIHTLGYDMPVSGCREGSVTGNLITGDAGSLNIRNGKAEYVYPQX
               |||||||||||||||||||||||||||||||||:||||||||||
orf81-1        LIHTLGYDMPVSGCREGSVTGNLITGDAGSLNIRDGKAEYVYPQX
                  490        500        510        520
```

Furthermore, ORF81ng shows significant homology to an *E. coli* OMP:

```
gi|1256380 (U50906) outer membrane adherence protein-associated protein
[E. coli] Length = 547
Score = 87.4 bits (213), Expect = 2e-16
Identities = 122/468 (26%), Positives = 198/468 (42%), Gaps =
70/468 (14%)

Query:  25 VFGIETLPAAKMAETFA-LTFMIAALYLFARYKAS--RLLIAVFFAFSMIANNVHYAVYQ  81
           VFGI  L A+  A     L F+  ++  R   +    RLL+A F   + A ++   ++Y
Sbjct:  29 VFGITNLVASSGAHMVQRLLFFVLTILVVKRISSLPLRLLVAAPFVL-LTAADMSISLY-  86

Query:  82 SWMT-------GINYWLMLKEVTEVGSAGASMLDKLWLPALWGVAEVMLFCSLAKFRRKT 134
           SW T       G    ++  +  EV    A ML  ++ P L    A +L           +
Sbjct:  87 SWCTFGTTFNDGFAISVLQSDPDEV----AKMLG-MYSPYLCAFAFLSLLFLAVIIKYDV 141

Query: 135 HFSADILFAFLMLMIFVRSF---------DTKQEHGISPKPTYSRIKAN--YFSFGYFVG 183
                +   L+L++   S          D K ++    SP    SR    +F+  YF  
Sbjct: 142 SLPTKKVTGILLLIVISGSLFSACQFAYKDAKNKNAFSPYILASRFATYTPFFNLNYFAL 201

Query: 184 RVLPYQ--LFDLSKIPVFKQPAPSKIGQGSIQNIVLIMGESESAAHLKLFGYGRETSPFL 241
                +Q  L   + +P F+    +     I   VLI+GES   ++ L+GY R T+P  +
Sbjct: 202 AAKEHQRLLSIANTVPYFQL----SVRDTGIDTYVLIVGESVRVDNMSLYGYTRSTTPQV 257

Query: 242 TRLSQADFKPIVKQSYSAGFMTAVSLP---SFFNVIPHANGLEQISGGDTNMFRLAKEQG 298
           +Q    + Q+ S       TA+S+P    + +V+ H      I       N+  +A + G
Sbjct: 258 E--AQRKQIKLFNQAISGAPYTALSVPLSLTADSVLSH-----DIHNYPDNIINMANQAG 310

Query: 299 YETYFYSAQA---ENQMAILNLIGKKWIDHLIQPTQLGYGNGDNMPDEKLLPLFDKINLQ 355
           ++T++  S+Q+   +N  A+ ++              ++  +  Y  G    DE LLP    +   Q
Sbjct: 311 FQTFWLSSQSAFRQNGTAVTSI--------AMRAMETVYVRGF---DELLLPHLSQALQQ 359

Query: 356 --QGRHFIVLHQRGSHAPYGALLQPQDKVFGEADIVDK-YDNTIHKTDQMIQTVFEQLQK 412
             Q +  IVLH  GSH P +        VF  D  D   YDN+IH TD ++  VFE L+
Sbjct: 360 NTQQKKLIVLHLNGSHEPACSAYPQSSAVFQPQDDQDACYDNSIHYTDSLLGQVFELLK- 418

Query: 413 QPDGNWLFAYTSDHG---QYVRQDIYNQG--TVQPDSYIVPL-VLYSP              454
             D     Y +DHG    ++++Y  G      +Y VP+ + YSP
Sbjct: 419 --DRRASVMYFADHGLERDPTKKNVYFHGGREASQQAYHVPMFIWYSP              464
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 37

The following partial DNA sequence was identified in *N. meningitidis* <SEQ ID 311>:

```
  1 ...ACCCTGCTCC TCTTCATCCC CCTCGTCCTC ACAC.GTGCG GCACACTGAC
 51 CGGCATACTC GCCCaCGGCG GCGGCAAACG CTTTGCCGTC GAACAAGAAC
101 TCGTCGCCGC ATCGTCCCGC GCCGCCGTCA AAGAAATGGA TTTGTCCGCC
151 yTAAAAGGAC GCAAAGCCGC CyTTTACGTC TCCGTTATGG GCGACCAAGG
201 TTCGGGCAAC ATAAGCGGCG GACGCTACTC TATCGACGCA CTGATACGCG
251 GCGGCTACCA CAACAACCCC GAAAGTGCCA CCCAATACAG CTACCCCGCC
301 TACGACACTA CCGCCACCAC CAAATCCGAC GCGCTCTCCA GCGTAACCAC
351 TTCCACATCG CTTTTGAACG CCCCCGCCGC CGyCyTGACG AAAAACAGCG
401 GACGCAAAGG CGAACGcTCC GCCGGACTGT CCGTCAACGG CACGGGCGAC
451 TACCGCAACG AAACCCTGCT CGCCAACCCC CGCGACGTTT CCTTCCTGAC
501 CAACCTCATC CAAACCGTCT TCTACCTGCG CGGCATCGAA GTCgTACCGC
551 CCGrATACGC CGACACCGAC GTATTCGTAA CCGTCGACGT A...
```

This corresponds to the amino acid sequence <SEQ ID 312; ORF83>:

```
  1 ..TLLLFIPLVL TXCGTLTGIL AHGGGKRFAV EQELVAASSR AAVKEMDLSA
 51 LKGRKAAXYV SVMGDQGSGN ISGGRYSIDA LIRGGYHNNP ESATQYSYPA
101 YDTTATTKSD ALSSVTTSTS LLNAPAAXLT KNSGRKGERS AGLSVNGTGD
151 YRNETLLANP RDVSFLTNLI QTVFYLRGIE VVPPXYADTD VFVTVDV..
```

Further work revealed the complete nucleotide sequence <SEQ ID 313>:

```
  1 ATGAAAACCC TGCTCCTCCT CATCCCCCTC GTCCTCACAG CCTGCGGCAC
 51 ACTGACCGGC ATACCCGCCC ACGGCGGCGG CAAACGCTTT GCCGTCGAAC
101 AAGAACTCGT CGCCGCATCG TCCCGCGCCG CCGTCAAAGA AATGGATTTG
151 TCCGCCCTAA AAGGACGCAA AGCCGCCCTT TACGTCTCCG TTATGGGCGA
201 CCAAGGTTCG GGCAACATAA GCGGCGGACG CTACTCTATC GACGCACTGA
251 TACGCGGCGG CTACCACAAC AACCCCGAAA GTGCCACCCA ATACAGCTAC
301 CCCGCCTACG ACACTACCGC CACCACCAAA TCCGACGCGC TCTCCAGCGT
351 AACCACTTCC ACATCGCTTT TGAACGCCCC CGCCGCCGCC CTGACGAAAA
401 ACAGCGGACG CAAAGGCGAA CGCTCCGCCG GACTGTCCGT CAACGGCACG
451 GGCGACTACC GCAACGAAAC CCTGCTCGCC AACCCCCGCG ACGTTTCCTT
501 CCTGACCAAC CTCATCCAAA CCGTCTTCTA CCTGCGCGGC ATCGAAGTCG
551 TACCGCCCGA ATACGCCGAC ACCGACGTAT TCGTAACCGT CGACGTATTC
601 GGCACCGTCC GCAGCCGTAC CGAACTGCAC CTCTACAACG CCGAAACCCT
651 TAAAGCCCAA ACCAAGCTCG AATATTTCGC CGTTGACCGC GACAGCCGGA
```

```
701 AACTGCTGAT TACCCCTAAA ACCGCCGCCT ACGAATCCCA ATACCAAGAA

751 CAATACGCCC TTTGGACCGG CCCTTACAAA GTCAGCAAAA CCGTCAAAGC

801 CTCAGACCGC TGATGGTCG ATTTCTCCGA CATTACCCCC TACGGCGACA

851 CAACCGCCCA AAACCGTCCC GACTTCAAAC AAAACAACGG TAAAAAACCC

901 GATGTCGGCA ACGAAGTCAT CCGCCGCCGC AAAGGAGGAT AA
```

This corresponds to the amino acid sequence <SEQ ID 314; ORF83-1>:

```
  1 MKTLLLLIPL VLTACGTLTG IPAHGGGKRF AVEQELVAAS SRAAVKEMDL

51 SALKGRKAAL YVSVMGDQGS GNISGGRYSI DALIRGGYHN NPESATQYSY

101 PAYDTTATTK SDALSSVTTS TSLLNAPAAA LTKNSGRKGE RSAGLSVNGT

151 GDYRNETLLA NPRDVSFLTN LIQTVFYLRG IEVVPPEYAD TDVFVTVDVF

201 GTVRSRTELH LYNAETLKAQ TKLEYFAVDR DSRKLLITPK TAAYESQYQE

251 QYALWTGPYK VSKTVKASDR LMVDFSDITP YGDTTAQNRP DFKQNNGKKP

301 DVGNEVIRRR KGG*
```

Computer analysis of this amino acid sequence gave the following results:

Homology with a Predicted ORF from *N. meningitidis* (Strain A)

ORF83 shows 96.4% identity over a 197aa overlap with an ORF (ORF83a) from strain A of *N. meningitidis*:

```
                    10         20         30         40         50
    orf83.pep   TLLLFIPLVLTXCGTLTGILAHGGGKRFAVEQELVAASSRAAVKEMDLSALKGRKAAX
                ||| :|||||| |||||| |||||||||||||||||||||||||||||||||||||
    orf83a      MKTLLXLIPLVLTACGTLTGIPAHGGGKRFAVEQELVAASSRAAVKEMDLSALKGRKAAL
                        10         20         30         40         50         60

60         70         80         90        100        110
    orf83.pep   YVSVMGDQGSGNISGGRYSIDALIRGGYHNNPESATQYSYPAYDTTATTKSDALSSVTTS
                ||||||||||||||||||||||||||||||||||||||||||||||||||||||||||||
    orf83a      YVSVMGDQGSGNISGGRYSIDALIRGGYHNNPESATQYSYPAYDTTATTKSDALSSVTTS
                        70         80         90        100        110        120

120        130        140        150        160        170
    orf83.pep   TSLLNAPAAXLTKNSGRKGERSAGLSVNGTGDYRNETLLANPRDVSFLTNLIQTVFYLRG
                |||||||||| |||||||||||||||||||||||||||||||||||||||||||||||||
    orf83a      TSLLNAPAAALTKNSGRKGERSAGLSVNGTGDYRNETLLANPRDVSFLTNLIQTVFYLRG
                        130        140        150        160        170        180

180        190
    orf83.pep   IEVVPPXYADTDVFVTVDV
                |||||| |||||||||||||
    orf83a      IEVVPPEYADTDVFVTVDVFGTVRSRTELHLYNAETLKAQTKLEYFAVDRDSRKLLIAPK
                        190        200        210        220        230        240
```

The complete length ORF83a nucleotide sequence <SEQ ID 315> is:

```
  1 ATGAAAACCC TGCTCNTCCT CATCCCCCTC GTCCTCACAG CCTGCGGCAC

51 ACTGACCGGC ATACCCGCCC ACGGCGGCGG CAAACGCTTT GCCGTCGAAC

101 AAGAACTCGT CGCCGCATCG TCCCGCGCCG CCGTCAAAGA AATGGACTTG

151 TCCGCCCTGA AAGGACGCAA AGCCGCCCTT TACGTCTCCG TTATGGGCGA
```

```
-continued
201 CCAAGGTTCG GGCAACATAA GCGGCGGACG CTACTCTATC GACGCACTGA

251 TACGCGGCGG CTACCACAAC AACCCCGAAA GTGCCACCCA ATACAGCTAC

301 CCCGCCTACG ACACTACCGC CACCACCAAA TCCGACGCGC TCTCCAGCGT

351 AACCACTTCC ACATCGCTTT TGAACGCCCC CGCCGCCGCC CTGACGAAAA

401 ACAGCGGACG CAAAGGCGAA CGCTCCGCCG GACTGTCCGT CAACGGCACG

451 GGCGACTACC GCAACGAAAC CCTGCTCGCC AACCCCGCG ACGTTTCCTT

501 CCTGACCAAC CTCATCCAAA CCGTCTTCTA CCTGCGCGGC ATCGAAGTCG

551 TACCGCCCGA ATACGCCGAC ACCGACGTAT TCGTAACCGT CGACGTATTC

601 GGCACCGTCC GCAGCCGCAC CGAACTGCAC CTCTACAACG CCGAAACCCT

651 TAAAGCCCAA ACCAAGCTCG AATATTTCGC CGTTGACCGC GACAGCCGGA

701 AACTGCTGAT TGCCCCTAAA ACCGCCGCCT ACGAATCCCA ATACCAAGAA

751 CAATACGCCC TCTGGATGGG ACCTTACAGC GTCGGCAAAA CCGTCAAAGC

801 CTCAGACCGC CTGATGGTCG ATTTCTCCGA CATCACCCCC TACGGCGACA

851 CAACCGCCCA AAACCGTCCC GACTTCAAAC AAAACAACGG TAAAAAACCC

901 GATGTCGGCA ACGAAGTCAT CCGCCGCCGC AAAGGAGGAT AA
```

This encodes a protein having amino acid sequence <SEQ ID 316>:

```
  1 MKTLLXLIPL VLTACGTLTG TPAHGGGKRF AVEQELVAAS SRAAVKEMDL
 51 SALKGRKAAL YVSVMGDQGS GNISGGRYSI DALIRGGYHN NPESATQYSY
101 PAYDTTATTK SDALSSVTTS TSLLNAPAAA LTKNSGRKGE RSAGLSVNGT
151 GDYRNETLLA NPRDVSFLTN LIQTVFYLRG IEVVPPEYAD TDVFVTVDVF
201 GTVRSRTELH LYNAETLKAQ TKLEYFAVDR DSRKLLIAPK TAAYESQYQE
251 QYALWMGPYS VGKTVKASDR LMVDFSDITP YGDTTAQNRP DFKQNNGKKP
301 DVGNEVIRRR KGG*
```

ORF83a and ORF83-1 show 98.4% identity in 313 aa overlap:

```
                 10         20         30         40         50         60
orf83a.pep   MKTLLXLIPLVLTACGTLTGIPAHGGGKRFAVEQELVAASSRAAVKEMDLSALKGRKAAL
             |||||  |||||||||||||||||||||||||||||||||||||||||||||||||||||
orf83-1      MKTLLLLIPLVLTACGTLTGIPAHGGGKRFAVEQELVAASSRAAVKEMDLSALKGRKAAL
                 10         20         30         40         50         60

70         80         90        100        110        120
orf83a.pep   YVSVMGDQGSGNISGGRYSIDALIRGGYHNNPESATQYSYPAYDTTATTKSDALSSVTTS
             ||||||||||||||||||||||||||||||||||||||||||||||||||||||||||||
orf83-1      YVSVMGDQGSGNISGGRYSIDALIRGGYHNNPESATQYSYPAYDTTATTKSDALSSVTTS
                 70         80         90        100        110        120

130        140        150        160        170        180
orf83a.pep   TSLLNAPAAALTKNSGRKGERSAGLSVNGTGDYRNETLLANPRDVSFLTNLIQTVFYLRG
             ||||||||||||||||||||||||||||||||||||||||||||||||||||||||||||
orf83-1      TSLLNAPAAALTKNSGRKGERSAGLSVNGTGDYRNETLLANPRDVSFLTNLIQTVFYLRG
                130        140        150        160        170        180

190        200        210        220        230        240
orf83a.pep   IEVVPPEYADTDVFVTVDVFGTVRSRTELHLYNAETLKAQTKLEYFAVDRDSRKLLIAPK
             |||||||||||||||||||||||||||||||||||||||||||||||||||||||||:||
orf83-1      IEVVPPEYADTDVFVTVDVFGTVRSRTELHLYNAETLKAQTKLEYFAVDRDSRKLLITPK
                190        200        210        220        230        240
```

-continued

```
                   250       260       270       280       290       300
orf83a.pep    TAAYESQYQEQYALWMGPYSVGKTVKASDRLMVDFSDITPYGDTTAQNRPDFKQNNGKKP
              ||||||||||||| ||| :|:||||||||||||||||||||||||||||||||||||||
orf83-1       TAAYESQYQEQYALWTGPYKVSKTVKASDRLMVDFSDITPYGDTTAQNRPDFKQNNGKKP
                   250       260       270       280       290       300
                   310
orf83a.pep    DVGNEVIRRRKGGX
              ||||||||||||||
orf83-1       DVGNEVIRRRKGGX
                   310
```

Homology with a Predicted ORF from *N. gonorrhoeae*

ORF83 shows 94.9% identity over a 197aa overlap with a predicted ORF (ORF83.ng) from *N. gonorrhoeae*:

```
orf83.pep     TLLLFIPLVLTXCGTLTGILAHGGGKRFAVEQELVAASSRAAVKEMDLSALKGRKAAX    58
              |||| |||||| ||||||| |||||||||||||||||||||||||||||||||||||
orf83ng       MKTLLLLIPLVLTACGTLTGIPAHGGGKRFAVEQELVAASSRAAVKEMDLSALKGRKAAL   60
orf83.pep     YVSVMGDQGSGNISGGRYSIDALIRGGYHNNPESATQYSYPAYDTTATTKSDALSSVTTS  118
              ||||||||||||||||||||||||||||||||| :|||:||||||||||||||||:||||
orf83ng       YVSVMGDQGSGNISGGRYSIDALIRGGYHNNPDSATRYSYPAYDTTATTKSDALSGVTTS  120
orf83.pep     TSLLNAPAAXLTKNSGRKGERSAGLSVNGTGDYRNETLLANPRDVSFLTNLIQTVFYLRG  178
              ||||||||| |||:||||||||||||||||||||||||||||||||||||||||||||||
orf83ng       TSLLNAPAAALTKNNGRKGERSAGLSVNGTGDYRNETLLANPRDVSFLTNLIQTVFYLRG  180
orf83.pep     IEVVPPXYADTDVFVTVDV                                           197
              |||||| ||||||||||||
orf83ng       IEVVPPEYADTDVFVTVDVFGTVRSRTELHLYNAETLKAQTKLEYFAVDRDSRKLLIAPK  240
```

The complete length ORF83ng nucleotide sequence <SEQ ID 317> is:

```
  1 ATGAAAACCC TGCTCCTCCT CATCCCCCTC GTACTCACCG CCTGCGGCAC

51 ACTGACCGGC ATACCCGCCC ACGGCGGCGG CAAACGCTTT GCCGTCGAAC

101 AGGAACTCGT CGCCGCATCG TCCCGCGCCG CCGTCAAAGA AATGGACTTG

151 TCCGCCCTGA AAGGACGCAA AGCCGCCCTT TACGTCTCCG TTATGGGCGA

201 CCAAGGTTCG GGCAACATAA GCGGCGGACG CTACTCCATC GACGCACTGA

251 TACGCGGCGG CTACCACAAC AACCCCGACA GCGCCACCCG ATACAGCTAC

301 CCCGCCTATG ACACTACCGC CACCACCAAA TCCGACGCGC TCTCCGGCGT

351 AACCACTTCC ACATCGCTTT TGAACGCCCC CGCCGCCGCC CTGACGAAAA

401 ACAACGGACG CAAAGGCGAA CGCTCCGCCG GACTGTCCGT CAACGGCACG

451 GGCGACTACC GCAACGAAAC CCTGCTCGCC AACCCCCGCG ACGTTTCCTT

501 CCTGACCAAC CTCATCCAAA CCGTCTTCTA CCTGCGCGGC ATCGAAGTCG

551 TACCGCCCGA ATACGCCGAC ACCGACGTAT TCGTAACCGT CGACGTATTC

601 GGCACCGTCC GCAGCCGTAC CGAACTGCAC CTCTACAACG CCGAAACCCT

651 TAAAGCCCAA ACCAAGCTCG AATATTTCGC CGTCGACCGC GACAGCCGGA

701 AACTGCTGAT TGCCCCTAAA ACCGCCGCCT ACGAATCCCA ATACCAAGAA

751 CAATACGCCC TCTGGATGGG ACCTTACAGC GTCGGCAAAA CCGTCAAAGC

801 CTCAGACCGC CTGATGGTCG ATTTCTCCGA CATCACCCCC TACGGCGACA

851 CAACCGCCCA AAACCGTCCC GACTTCAAAC AAAACAACGG TAAAAACCCC

901 GATGTCGGCA ACGAAGTCAT CCGCCGCCGC AAAGGAGGAT AA
```

This encodes a protein having amino acid sequence <SEQ ID 318>:

```
  1 MKTLLLLIPL VLTACGTLTG IPAHGGGKRF AVEQELVAAS SRAAVKEMDL
 51 SALKGRKAAL YVSVMGDQGS GNISGGRYSI DALIRGGYHN NPDSATRYSY
101 PAYDTTATTK SDALSGVTTS TSLLNAPAAA LTKNNGRKGE RSAGLSVNGT
151 GDYRNETLLA NPRDVSFLTN LIQTVFYLRG IEVVPPEYAD TDVFVTVDVF
201 GTVRSRTELH LYNAETLKAQ TKLEYFAVDR DSRKLLIAPK TAAYESQYQE
251 QYALWMGPYS VGKTVKASDR LMVDFSDITP YGDTTAQNRP DFKQNNGKNP
301 DVGNEVIRRR KGG*
```

ORF83ng and ORF83-1 show 97.1% identity in 313 aa overlap

```
                    10         20         30         40         50         60
orf83-1.pep  MKTLLLLIPLVLTACGTLTGIPAHGGGKRFAVEQELVAASSRAAVKEMDLSALKGRKAAL
             ||||||||||||||||||||||||||||||||||||||||||||||||||||||||||||
orf83ng      MKTLLLLIPLVLTACGTLTGIPAHGGGKRFAVEQELVAASSRAAVKEMDLSALKGRKAAL
                    10         20         30         40         50         60
                    70         80         90        100        110        120
orf83-1.pep  YVSVMGDQGSGNISGGRYSIDALIRGGYHNNPESATQYSYPAYDTTATTKSDALSSVTTS
             |||||||||||||||||||||||||||||||:|||:||||||||||||||||||:||||
orf83ng      YVSVMGDQGSGNISGGRYSIDALIRGGYHNNPDSATRYSYPAYDTTATTKSDALSGVTTS
                    70         80         90        100        110        120
                   130        140        150        160        170        180
orf83-1.pep  TSLLNAPAAALTKNSGRKGERSAGLSVNGTGDYRNETLLANPRDVSFLTNLIQTVFYLRG
             ||||||||||||:|||||||||||||||||||||||||||||||||||||||||||||||
orf83ng      TSLLNAPAAALTKNNGRKGERSAGLSVNGTGDYRNETLLANPRDVSFLTNLIQTVFYLRG
                   130        140        150        160        170        180
                   190        200        210        220        230        240
orf83-1.pep  IEVVPPEYADTDVFVTVDVFGTVRSRTELHLYNAETLKAQTKLEYFAVDRDSRKLLITPK
             ||||||||||||||||||||||||||||||||||||||||||||||||||||||||:||
orf83ng      IEVVPPEYADTDVFVTVDVFGTVRSRTELHLYNAETLKAQTKLEYFAVDRDSRKLLIAPK
                   190        200        210        220        230        240
                   250        260        270        280        290        300
orf83-1.pep  TAAYESQYQEQYALWTGPYKVSKTVKASDRLMVDFSDITPYGDTTAQNRPDFKQNNGKKP
             ||||||||||||||| |||:|:||||||||||||||||||||||||||||||||||||:|
orf83ng      TAAYESQYQEQYALWMGPYSVGKTVKASDRLMVDFSDITPYGDTTAQNRPDFKQNNGKNP
                   250        260        270        280        290        300
                   310
orf83-1.pep  DVGNEVIRRRKGGX
             ||||||||||||||
orf83ng      DVGNEVIRRRKGGX
                   310
```

Based on this analysis, including the presence of a putative ATP/GTP-binding site motif A (P-loop) in the gonococcal protein (double-underlined) and a putative prokaryotic membrane lipoprotein lipid attachment site (single-underlined), it is predicted that the proteins from *N. meningitidis* and *N. gonorrhoeae*, and their epitopes, could be useful antigens for vaccines or diagnostics, or for raising antibodies.

Example 38

The following DNA sequence, believed to be complete, was identified in *N. meningitidis* <SEQ ID 319>:

```
  1 ATGGCAGAGA TCTGTTTGAT AACCGGCACG CCCGGTTCAG GGAAAACATT

51 AAAAATGGTT TCCATGATGG CGAATGATGA AATGTTTAAG CCTGATGAAA

101 AAGCCATACG CCGTAAAGTA TTTACGAACA TAAAAGGCTT GAAAATACCG

151 CACACCTACA TAGAAACGGA CGCAAAAAAG CTGCCGAAAT CGACAGATGA

201 GCAGCTTTCG GCGCATGATA TGTACGAATC GATAAAGAAG CCCGAAAATA

251 TCGGGTCTAT TGTCATTGTA GATGAAGCTC AAGACGTATG GCCGGCACGC
```

-continued

```
 301 TCGGCAGGTT CAAAAATCCC TGAAAATGTC CAATGGCTGA ATACGCACAG
 351 ACATCAGGGC ATTGATATAT TTGTTTTGAC TCAAGGTCCT AAGCTTCTAG
 401 ATCAAAATCT TAGAACGCTT GTACGGAAAC ATTACCACAT CGCTTCAAAC
 451 AAGATGGGTA TGCGTACGCT TTTAGAATGG AAAATATGCG CGGACGATCC
 501 CGTAAAAATG GCATCAAGCG CATTCTCCAG TATCTATACA CTGGATAAAA
 551 AAGTTTATGA CTTGTAysrr TmmGCGGAAG TTCATACCGT AAATAAGGTC
 601 AAGCGGTCAA AGTGGTTTTA CACTCTGCCa GTAATAGTAT TGCTCATTCC
 651 CGTGTTTGTC GGCCTGTCCT ATAAAATGTT GagCaGTTAC GGAAAAAAAC
 701 aGGAAGAACC CGCAGCACAA GAATCGGCGG CAACAGAACA GCAGGCAGTA
 751 CTTCCGGATA AACAGAAGG CGAGCCGGTA ATAACGGCA ACCTTACCGC
 801 AGATATGTTT GTTCCGACAT TGTCCGAaAA ACCCGrAAGC AAGCcgaTTT
 851 ATAACGGTGT AAGGCAGGTA AGAACCTTTG AATATATAGC AGGCTGTATA
 901 GAAGGCGGAA GAACCGGATG CGCCTGCTAT TCGCaTCAAG GGACGCCATt
 951 gaAAGAAGTG ACGGaGTTGA TGTGccaAgG aCTATGTaAA AAacGGCTTG
1001 CCGTTTAACC CaTACAAAGA AGAAAGCCAA GGGCAGGAAG TTCAGCAAAG
1051 CGCGCAgCAA CATTCGGACA GGGCGcCAAG TTGCCACATT GGGCGGAAAA
1101 CCGTAGCAGA ACCTAATGTA CGATAATTGG GAAGAACGCG GGAAACCGTT
1151 TGAAGGAATC GGaCGGGGGC GTGGTCGGAT CGGCAAACTG A
```

This corresponds to the amino acid sequence <SEQ ID 320; ORF84>:

```
  1 MAEICLITGT PGSGKTLKMV SMMAANDEMFK PDEKAIRRKV FTNIKGLKIP
 51 HTYIETDAKK LPKSTDEQLS AHDMYEWIKK PENIGSIVIV DEAQDVWPAR
101 SAGSKIPENV QWLNTHRHQG IDIFVLTQGP KLLDQNLRTL VRKHYHIASN
151 KMGMRTLLEW KICADDPVKM ASSAFSSIYT LDKKVYDLYX XAEVHTVNKV
201 KRSKWFYTLP VIVLLIPVFV GLSYKMLSSY GKKQEEPAAQ ESAATEQQAV
251 LPDKTEGEPV NNGNLTADMF VPTLSEKPXS KPIYNGVRQV RTFEYIAGCI
301 EGGRTGCACY SHQGTALKEV TELMCKDYVK NGLPFNPYKE ESQGQEVQQS
351 AQQHSDRAQV ATLGGKPXQN LMYDNWEERG KPFEGIGGGV VGSAN*
```

Further work revealed the complete nucleotide sequence <SEQ ID 321>:

```
  1 ATGGCAGAGA TCTGTTTGAT AACCGGCACG CCCGGTTCAG GGAAAACATT
 51 AAAAATGGTT TCCATGATGG CGAATGATGA AATGTTTAAG CCTGATGAAA
101 ACGGCATACG CCGTAAAGTA TTTACGAACA TAAAAGGCTT GAAAATACCG
151 CACACCTACA TAGAAACGGA CGCAAAAAAG CTGCCGAAAT CGACAGATGA
201 GCAGCTTTCG GCGCATGATA TGTACGAATG GATAAAGAAG CCCGAAAATA
251 TCGGGTCTAT TGTCATTGTA GATGAAGCTC AAGACGTATG GCCGGCACGC
301 TCGGCAGGTT CAAAAATCCC TGAAAATGTC CAATGGCTGA ATACGCACAG
```

-continued

```
 351 ACATCAGGGC ATTGATATAT TTGTTTTGAC TCAAGGTCCT AAGCTTCTAG
 401 ATCAAAATCT TAGAACGCTT GTACGGAAAC ATTACCACAT CGCTTCAAAC
 451 AAGATGGGTA TGCGTACGCT TTTAGAATGG AAAATATGCG CGGACGATCC
 501 CGTAAAAATG GCATCAAGCG CATTCTCCAG TATCTATACA CTGGATAAAA
 551 AAGTTTATGA CTTGTACGAA TCAGCGGAAG TTCATACCGT AAATAAGGTC
 601 AAGCGGTCAA AGTGGTTTTA CACTCTGCCA GTAATAGTAT TGCTGATTCC
 651 CGTGTTTGTC GGCCTGTCCT ATAAAATGTT GAGCAGTTAC GGAAAAAAAC
 701 AGGAAGAACC CGCAGCACAA GAATCGGCGG CAACAGAACA GCAGGCAGTA
 751 CTTCCGGATA AAACAGAAGG CGAGCCGGTA AATAACGGCA ACCTTACCGC
 801 AGATATGTTT GTTCCGACAT TGTCCGAAAA ACCCGAAAGC AAGCCGATTT
 851 ATAACGGTGT AAGGCAGGTA AGAACCTTTG AATATATAGC AGGCTGTATA
 901 GAAGGCGGAA GAACCGGATG CGCCTGCTAT TCGCATCAAG GGACGGCATT
 951 GAAAGAAGTG ACGGAGTTGA TGTGCAAGGA CTATGTAAAA AACGGCTTGC
1001 CGTTTAACCC ATACAAAGAA GAAAGCCAAG GGCAGGAAGT TCAGCAAAGC
1051 GCGCAGCAAC ATTCGGACAG GGCGCAAGTT GCCACATTGG GCGGAAAACC
1101 GTAGCAGAAC CTAATGTACG ATAATTGGGA AGAACGCGGG AAACCGTTTG
1151 AAGGAATCGG CGGGGGCGTG GTCGGATCGG CAAACTGA
```

This corresponds to the amino acid sequence <SEQ ID 322; ORF84-1>:

```
  1 MAEICLITGT PGSGKTLKMV SMMANDEMFK PDENGIRRKV FTNIKGLKIP
 51 HTYIETDAKK LPKSTDEQLS AHDMYEWIKK PENIGSIVIV DEAQDVWPAR
101 SAGSKIPENV QWLNTHRHQG IDIFVLTQGP KLLDQNLRTL VRKHYHIASN
151 KMGMRTLLEW KICADDPVKM ASSAFSSIYT LDKKVYDLYE SAEVHTVNKV
201 KRSKWFYTLP VIVLLIPVFV GLSYKMLSSY GKKQEEPAAQ ESAATEQQAV
251 LPDKTEGEPV NNGNLTADMF VPTLSEKPES KPIYNGVRQV RTFEYIAGCI
301 EGGRTGCACY SHQGTALKEV TELMCKDYVK NGLPFNPYKE ESQGQEVQQS
351 AQQHSDRAQV ATLGGKP*QN LMYDNWEERG KPFEGIGGGV VGSAN*
```

Computer analysis of this amino acid sequence gave the following results:

Homology with a Predicted ORF from *N. meningitidis* (Strain A)

ORF84 shows 93.9% identity over a 395aa overlap with an ORF (ORF84a) from strain A of *N. meningitidis*:

```
                  10         20         30         40         50         60
    orf84.pep  MAEICLITGTPGSGKTLKMVSMMANDEMFKPDEKAIRRKVFTNIKGLKIPHTYIETDAKK
               |||||||||||||||||||||||||||||||||||:: |||||||||||||||||||||||
    orf84a     MAEICLITGTPGSGKTLKMVSMMANDEMFKPDENGIRRKVFTNIKGLKIPHTYIETDAKK
                  10         20         30         40         50         60
```

```
                       70         80         90        100        110        120
orf84.pep   LPKSTDEQLSAHDMYEWIKKPENIGSIVIVDEAQDVWPARSAGSKIPENVQWLNTHRHQG
            ||||||||||||||||||||||||||||||||||||||||||||||||||||||||||||
orf84a      LPKSTDEQLSAHDMYEWIKKPENIGSIVIVDEAQDVWPARSAGSKIPENVQWLNTHRHQG
                       70         80         90        100        110        120
                      130        140        150        160        170        180
orf84.pep   IDIFVLTQGPKLLDQNLRTLVRKHYHIASNKMGMRTLLEWKICADDPVKMASSAFSSIYT
            ||||||||||  ||||||||||||||||||||||||||||||||||||||||||||||||
orf84a      IDIFVLTQGSKLLDQNLRTLVRKHYHIASNKMGMRTLLEWKICADDPVKMASSAFSSIYT
                      130        140        150        160        170        180
                      190        200        210        220        230        240
orf84.pep   LDKKVYDLYXXAEVHTVNKVKRSKWFYTLPVIVLLIPVFVGLSYKMLSSYGKKQEEPAAQ
            ||||||||||   |||||||||||||||||||||||: |||||||||||||||||||||
orf84a      LDKKVYDLYESAEVHTVNKVKRSKWFYTLPVIILLIPVFVGLSYKMLSSYGKKQEEPAAQ
                      190        200        210        220        230        240
                      250        260        270        280        290        300
orf84.pep   ESAATEQQAVLPDKTEGEPVNNGNLTADMFVPTLSEKPXSKPIYNGVRQVRTFEYIAGCI
            ||||||:|||: |||||||||||||||||||||||||| |||||||||||||||||||:
orf84a      ESAATEHQAVFQDKTEGEPVNNGNLTADMFVPTLSEKPESKPIYNGVRQVRTFEYIAGCV
                      250        260        270        280        290        300
                      310        320        330        340        350        360
orf84.pep   EGGRTGCACYSHQGTALKEVTELMCKDYVKNGLPFNPYKEESQGQEVQQSAQQHSDRAQV
            |||||||:|||||||||||:|: |||||::|||||||||||||::|||| |:|||| ||
orf84a      EGGRTGCTCYSHQGTALKEITKEMCKDYARNGLPFNPYKEESQGRDVQQSEQHHSDRPQV
                      310        320        330        340        350        360
                      370        380        390
orf84.pep   ATLGGKPXQNLMYDNWEERGKPFEGIGGGVVGSANX
            ||||||| ||||||||||:|||||||||||||||||
orf84a      ATLGGKPWQNLMYDNWQERGKPFEGIGGGVVGSANX
                      370        380        390
```

The complete length ORF84a nucleotide sequence <SEQ ID 323> is:

```
  1 ATGGCAGAGA TCTGTTTGAT AACCGGCACG CCCGGTTCAG GGAAAACATT
 51 AAAAATGGTT TCCATGATGG CAAACGATGA AATGTTTAAG CCGGATGAAA
101 ACGGCATACG CCGTAAAGTA TTTACGAACA TCAAAGGCTT GAAGATACCG
151 CACACCTACA TAGAAACGGA CGCCAAAAAG CTGCCGAAAT CGACAGATGA
201 GCAGCTTTCG GCGCATGATA TGTACGAATG GATAAAGAAG CCCGAAAATA
251 TCGGGTCTAT TGTCATTGTA GATGAAGCTC AAGACGTATG GCCGGCACGC
301 TCGGCAGGTT CAAAAATCCC TGAAAATGTC AATGGCTGAA ATACGCACAG
351 ACATCAGGGC ATTGATATAT TTGTTTTGAC TCAAGGCTCT AAGCTTCTAG
401 ATCAAAATCT TAGAACGCTT GTACGGAAAC ATTACCACAT CGCTTCAAAC
451 AAGATGGGTA TGCGTACGCT TTTAGAATGG AAAATATGCG CGGACGATCC
501 CGTAAAAATG GCATCAAGCG CATTCTCCAG TATCTATACA CTGGATAAAA
551 AAGTTTATGA CTTGTACGAA TCAGCGGAAG TTCATACCGT AAATAAGGTC
601 AAGCGGTCAA AATGGTTTTA TACTCTGCCA GTAATAATAT TGCTGATTCC
651 CGTTTTTGTC GGCCTGTCCT ATAAAATGTT AAGTAGTTAT GGAAAAAAAC
701 AGGAAGAACC CGCAGCACAA GAATCGGCGG CAACAGAACA TCAGGCAGTA
751 TTTCAGGATA AACAGAAGG CGAGCCGGTA ACAACGGTA ACCTTACCGC
801 AGATATGTTT GTTCCGACAT TGTCCGAAAA ACCCGAAAGC AAGCCGATTT
851 ATAACGGTGT AAGGCAGGTA AGAACCTTTG AATATATAGC AGGCTGTGTA
901 GAAGGCGGAA GAACCGGATG CACATGCTAT TCGCATCAAG GGACGGCATT
951 GAAAGAAATT ACAAAGGAAA TGTGCAAGGA TTACGCAAGA AACGGATTGC
```

```
1001 CGTTTAACCC ATATAAAGAA GAAAGCCAAG GCGGGATGT CCAGCAAAGT

1051 GAGCAGCACC ATTCGGACAG ACCGCAAGTT GCCACGTTGG GCGGAAAGCC

1101 GTGGCAAAAT CTTATGTATG ATAATTGGCA GGAGCGCGGA AAACCGTTTG

1151 AAGGAATCGG CGGGGGCGTG GTCGGATCGG CAAACTGA
```

This encodes a protein having amino acid sequence <SEQ ID 324>:

```
  1 MAEICLITGT PGSGKTLKMV SMMANDEMFK PDENGIRRKV FTNIKGLKIP

51 HTYIETDAKK LPKSTDEQLS AHDMYEWIKK PENIGSIVIV DEAQDVWPAR

101 SAGSKIPENV QWLNTHRHQG IDIFVLTQGS KLLDQNLRTL VRKHYHIASN

151 KMGMRTLLEW KICADDPVKM ASSAFSSIYT LDKKVYDLYE SAEVHTVNKV

201 KRSKWFYTLP VIILLIPVFV GLSYKMLSSY GKKQEEPAAQ ESAATEHQAV

251 FQDKTEGEPV NNGNLTADMF VPTLSEKPES KPIYNGVRQV RTFEYIAGCV

301 EGGRTGCTCY SHQGTALKEI TKEMCKDYAR NGLPFNPYKE ESQGRDVQQS

351 EQHHSDRPQV ATLGGKPWQN LMYDNWQERG KPFEGIGGGV VGSAN*
```

ORF84a and ORF84-1 show 95.2% identity in 395 aa overlap:

```
                      10         20         30         40         50         60
orf84a.pep   MAEICLITGTPGSGKTLKMVSMMANDEMFKPDENGIRRKVFTNIKGLKIPHTYIETDAKK
             ||||||||||||||||||||||||||||||||||||||||||||||||||||||||||||
orf84-1      MAEICLITGTPGSGKTLKMVSMMANDEMFKPDENGIRRKVFTNIKGLKIPHTYIETDAKK
                      10         20         30         40         50         60
                      70         80         90        100        110        120
orf84a.pep   LPKSTDEQLSAHDMYEWIKKPENIGSIVIVDEAQDVWPARSAGSKIPENVQWLNTHRHQG
             ||||||||||||||||||||||||||||||||||||||||||||||||||||||||||||
orf84-1      LPKSTDEQLSAHDMYEWIKKPENIGSIVIVDEAQDVWPARSAGSKIPENVQWLNTHRHQG
                      70         80         90        100        110        120
                     130        140        150        160        170        180
orf84a.pep   IDIFVLTQGSKLLDQNLRTLVRKHYHIASNKMGMRTLLEWKICADDPVKMASSAFSSIYT
             |||||||||| |||||||||||||||||||||||||||||||||||||||||||||||||
orf84-1      IDIFVLTQGPKLLDQNLRTLVRKHYHIASNKMGMRTLLEWKICADDPVKMASSAFSSIYT
                     130        140        150        160        170        180
                     190        200        210        220        230        240
orf84a.pep   LDKKVYDLYESAEVHTVNKVKRSKWFYTLPVIILLIPVFVGLSYKMLSSYGKKQEEPAAQ
             |||||||||||||||||||||||||||||||||||:||||||||||||||||||||||||
orf84-1      LDKKVYDLYESAEVHTVNKVKRSKWFYTLPVIVLLIPVFVGLSYKMLSSYGKKQEEPAAQ
                     190        200        210        220        230        240
                     250        260        270        280        290        300
orf84a.pep   ESAATEHQAVFQDKTEGEPVNNGNLTADMFVPTLSEKPESKPIYNGVRQVRTFEYIAGCV
             ||||||:|||:|||||||||||||||||||||||||||||||||||||||||||||||:
orf84-1      ESAATEQQAVLPDKTEGEPVNNGNLTADMFVPTLSEKPESKPIYNGVRQVRTFEYIAGCI
                     250        260        270        280        290        300
                     310        320        330        340        350        360
orf84a.pep   EGGRTGCTCYSHQGTALKEITKEMCKDYARNGLPFNPYKEESQGRDVQQSEQHHSDRPQV
             |||||||:||||||||||||:|::|||||:|||||||||||||||::|||:|||:||:||
orf84-1      EGGRTGCACYSHQGTALKEVTELMCKDYVKNGLPFNPYKEESQGQEVQQSAQQHSDRAQV
                     310        320        330        340        350        360
                     370        380        390
orf84a.pep   ATLGGKPWQNLMYDNWQERGKPFEGIGGGVVGSANX
             |||||||:|||||||||:||||||||||||||||||
orf84-1      ATLGGKPXQNLMYDNWEERGKPFEGIGGGVVGSANX
                     370        380        390
```

Homology with a Predicted ORF from *N. gonorrhoeae*
ORF84 shows 94.2% identity over a 395aa overlap with a predicted ORF (ORF84.ng) from *N. gonorrhoeae*:

```
orf84.pep    MAEICLITGTPGSGKTLKMVSMMANDEMFKPDEKAIRRKVFTNIKGLKIPHTYIETDAKK    60
             |||||||||||||||||||||||||||||||||::|||||||||||||||||:||||||
orf84ng      MAEICLITGTPGSGKTLKMVSMMANDEMFKPDENGVRRKVFTNIKGLKIPHTHIETDAKK    60 orf84.pep    LPKSTDEQLSAHDMYEWIKKPENIGSIVIVDEAQDVWPARSAGSKIPENVQWLNTHRHQG   120
             ||||||||||||||||||||||||:||||||||||||||||||||||||||||||||||
orf84ng      LPKSTDEQLSAHDMYEWIKKPENVGAIVIVDEAQDVWPARSAGSKIPENVQWLNTHRHQG   120 orf84.pep    IDIFVLTQGPKLLDQNLRTLVRKHYHIASNKMGMRTLLEWKICADDPVKMASSAFSSIYT   180
             ||||||||||||||||||||||||||::||||:||||||||:||||||||||||||||||
orf84ng      IDIFVLTQGPKLLDQNLRTLVKRHYHIAANKMGLRTLLEWKVCADDPVKMASSAFSSIYT   180 orf84.pep    LDKKVYDLYXXAEVHTVNKVKRSKWFYTLPVIVLLIPVFVGLSYKMLSSYGKKQEEPAAQ   240
             |||||||||   ||:|||||||||||:||||:||||:|||||||||||:||||||||||
orf84ng      LDKKVYDLYESAEIHTVNKVKRSKWFYALPVIILLIPLFVGLSYKMLGSYGKKQEEPAAQ   240 orf84.pep    ESAATEQQAVLPDKTEGEPVNNGNLTADMFVPTLSEKPXSKPIYNGVRQVRTFEYIAGCI   300
             ||||||||||||||||||:|||||||||||||||:|||:|||||||||||||||||||||
orf84ng      ESAATEQQAVLPDKTEGESVNNGNLTADMFVPTLPEKPESKPIYNGVRQVRTFEYIAGCI   300 orf84.pep    EGGRTGCACYSHQGTALKEVTELMCKDYVKNGLPFNPYKEESQGQEVQQSAQQHSDRAQV   360
             ||||||:|||||||||||||||||||||||||||||||||||||||||||||||||||||
orf84ng      EGGRTGCTCYSHQGTALKEVTELMCKDYVKNGLPFNPYKEESQGQEVQQSAQQHSDRAQV   360 orf84.pep    ATLGGKPXQNLMYDNWEERGKPFEGIGGGVVGSAN   395
             ||||||| |||||||||||||||||||||||||||
orf84ng      ATLGGKPQQNLMYDNWEERGKPFEGIGGGVVGSAN   395
```

The complete length ORF84ng nucleotide sequence <SEQ ID 325> is:

```
   1 ATGGCAGAAA TCTGTTTGAT AACCGGCACG CCCGGTTCAG GGAAAACATT
  51 AAAAATGGTT TCCATGATGG CAAACGATGA AATGTTTAAG CCAGATGAAA
 101 ACGGCGTACG CCGTAAAGTA TTTACGAACA TCAAAGGTTT GAAGATACCG
 151 CACACCCACA TAGAAACAGA CGCAAAGAAG CTGCCGAAAT CAACCGATGA
 201 ACAGCTTTCG GCGCATGATA TGTATGAATG GATCAAGAAG CCTGAAAacg
 251 tcggcgCAAT CGTTATTGTC GATGAGGCGC AAGACGTATG GCCCGCACGC
 301 TccgCAGGTT CGAAAATCCC CGAAAACGTC AATGGCTGA ACACACACAG
 351 GCATCAGGGC ATAGATATAT TTGTATTGAC ACAAGGTCCT AAACTCTTAG
 401 ATCAGAACTT GCGAACATTG GTTAAAGAC ATTACCACAT TGCGGCCAAC
 451 AAAATGGGTT TGCGTACCCT GCTTGAATGG AAAGTATGCG CGGATGACCC
 501 GGTAAAAATG GCATCAAGTG CATTTTCCAG TATCTACACA CTGGATAAAA
 551 AAGTTTATGA CTTGTACGAA TCCGCAGAAA TTCACACGGT AAACAAAGTC
 601 AAGCGTTCAA AATGGTTTTA TGCATTGCCC GTCATCATAT TATTGATTCC
 651 GCTATTTGTC GGTTTGTCTT ACAAAATGTT GGGCAGTTAC GGAAAAAAAC
 701 AGGAAGAACC CGCAGCACAA GAATCGGCGG CAACAGAACA GCAGGCAGTA
 751 CTTCCGGATA AAACAGAAGG AGAATCGGTG AATAACGGAA ACCTTACGGC
 801 AGATATGTTT GTTCCGACAT TGCCCGAAAA ACCCGAAAGC AAGCCGATTT
 851 ATAACGGTGT AAGGCAGGTA AGGACCTTTG AATATATAGC AGGCTGTATA
 901 GAAGGCGGAA GAACCGGATG CACCTGCTAT TCGCATCAAG GGACGGCATT
 951 GAAAGAAGTG ACGGAGTTGA TGTGCAAGGA CTATGTAAAA AACGGCTTGC
1001 CGTTTAACCC ATACAAAGAA GAAAGCCAAG GGCAGGAAGT TCAGCAAAGC
```

-continued
```
1051 GCGCAGCAAC ATTCGGACAG GGCGCAAGTT GCCACCTTGG GCGGAAAACC

1101 GCAGCAGAAC CTAATGTACG ACAATTGGGA AGAACGCGGG AAACCGTTTG

1151 AAGGAATCGG CGGGGGCGTG GTCGGATCGG CAAACTGA
```

This encodes a protein having amino acid sequence <SEQ ID 326>:

```
  1 MAEICLITGT PGSGKTLKMV SMMANDEMFK PDENGVRRKV FTNIKGLKIP

51 HTHIETDAKK LPKSTDEQLS AHDMYEWIKK PENVGAIVIV DEAQDVWPAR

101 SAGSKIPENV QWLNTHRHQG IDIFVLTQGP KLLDQNLRTL VKRHYHIAAN

151 KMGLRTLLEW KVCADDPVKM ASSAFSSIYT LDKKVYDLYE SAEIHTVNKV

201 KRSKWFYALP VIILLIPLFV GLSYKMLGSY GKKQEEPAAQ ESAATEQQAV

251 LPDKTEGESV NNGNLTADMF VPTLPEKPES KPIYNGVRQV RTFEYIAGCI

301 EGGRTGCTCY SHQGTALKEV TELMCKDYVK NGLPFNPYKE ESQGQEVQQS

351 AQQHSDRAQV ATLGGKPQQN LMYDNWEERG KPFEGIGGGV VGSAN*
```

ORF84ng and ORF84-1 show 95.4% identity in 395 aa overlap:

```
                        10         20         30         40         50         60
orf84-1.pep    MAEICLITGTPGSGKTLKMVSMMANDEMFKPDENGIRRKVFTNIKGLKIPHTYIETDAKK
               ||||||||||||||||||||||||||||||||||||:||||||||||||||:||||||
orf84ng        MAEICLITGTPGSGKTLKMVSMMANDEMFKPDENGVRRKVFTNIKGLKIPHTHIETDAKK
                        10         20         30         40         50         60

70         80         90        100        110        120
orf84-1.pep    LPKSTDEQLSAHDMYEWIKKPENIGSIVIVDEAQDVWPARSAGSKIPENVQWLNTHRHQG
               |||||||||||||||||||||||:::||||||||||||||||||||||||||||||||||
orf84ng        LPKSTDEQLSAHDMYEWIKKPENVGAIVIVDEAQDVWPARSAGSKIPENVQWLNTHRHQG
                        70         80         90        100        110        120

130        140        150        160        170        180
orf84-1.pep    IDIFVLTQGPKLLDQNLRTLVRKHYHIASNKMGMRTLLEWKICADDPVKMASSAFSSIYT
               ||||||||||||||||||||:||||||||::||||:||||:|||||||:|||||||||||
orf84ng        IDIFVLTQGPKLLDQNLRTLVKRHYHIAANKMGLRTLLEWKVCADDPVKMASSAFSSIYT
                        130        140        150        160        170        180

190        200        210        220        230        240
orf84-1.pep    LDKKVYDLYESAEVHTVNKVKRSKWFYTLPVIVLLIPVFVGLSYKMLSSYGKKQEEPAAQ
               |||||||||||:||||||||||||||||:||||:||||:||||||||||:||||||||||
orf84ng        LDKKVYDLYESAEIHTVNKVKRSKWFYALPVIILLIPLFVGLSYKMLGSYGKKQEEPAAQ
                        190        200        210        220        230        240

250        260        270        280        290        300
orf84-1.pep    ESAATEQQAVLPDKTEGEPVNNGNLTADMFVPTLSEKPESKPIYNGVRQVRTFEYIAGCI
               |||||||||||||||||||| ||||||||||||| |||||||||||||||||||||||||
orf84ng        ESAATEQQAVLPDKTEGESVNNGNLTADMFVPTLPEKPESKPIYNGVRQVRTFEYIAGCI
                        250        260        270        280        290        300

310        320        330        340        350        360
orf84-1.pep    EGGRTGCACYSHQGTALKEVTELMCKDYVKNGLPFNPYKEESQGQEVQQSAQQHSDRAQV
               ||||||:||||||||||||||||||||||||||||||||||||||||||||||||||||
orf84ng        EGGRTGCTCYSHQGTALKEVTELMCKDYVKNGLPFNPYKEESQGQEVQQSAQQHSDRAQV
                        310        320        330        340        350        360

370        380        390
orf84-1.pep    ATLGGKPXQNLMYDNWEERGKPFEGIGGGVVGSANX
               |||||||:|||||||||||||||||||||||||||
orf84ng        ATLGGKPQQNLMYDNWEERGKPFEGIGGGVVGSANX
                        370        380        390
```

Based on this analysis, including the presence of a putative transmembrane domain (single-underlined) in the gonococcal protein, and a putative ATP/GTP-binding site motif A (P-loop, double-underlined), it is predicted that the proteins from *N. meningitidis* and *N. gonorrhoeae*, and their epitopes, could be useful antigens for vaccines or diagnostics, or for raising antibodies.

Example 39

The following partial DNA sequence was identified in *N. meningitidis* <SEQ ID 327>:

```
   1 GTGGTTTTCC TGAATGCCGA CAACGGGATA TTGGTTCAGG ACTTGCCTTT

51 TGAAGTCAAA CTGAAAAAAT TCCATATCGA TTTTTACAAT ACGGGTATGC

101 CGCGTGATTT CGCCAGCGAT ATTGAAGTGA CGGACAAGGC AACCGGTGAG

151 AAACTCGAGC GCACCATCCG CGTGAACCAT CCTTTGACCT TGCACGGCAT

201 CACGATTTAT CAGGCGAGTT TTGCCGACGG CGGTTCGGAT TTGACATTCA

251 AGGCGTGGAA TTTGGGTGAT GCTTCGCGCG AGCCTGTCGT GTTGAAGGCA

301 ACATCCATAC ACCAGTTTCC GTTGGAAATT GGCAAACACA AATATCGTCT

351 TGAGTTCGAT CAGTTCACTT CTATGAATGT GGAGGACATG AGCGAGGGCG

401 CGGAACGGGA AAAAAGCCTG AAATCCACGC TGCCCGATGT CCGCGCCGTT

451 ACTCAGGAAG GTCACAAATA CACCAAT... .......... .....TACCG

501 TATCCGTGAT GCGCCAGGCC AGGCGGTCGA ATATAAAAAC TATATGCTGC

551 CGGTTTTGCA GGAACAGGAT TATTTTTGGA TTACCGGCAC GCGCAGCGC.

601 TTGCAGCAGC AATACCGCTG GCTGCGTATC CCCTTGGACA AGCAGTTGAA

651 AGCGGACACC TTTATGGCAT TGCGTGAGTT TTTGAAAGAT GGGGAAGGGC

701 GCAAACGTCT .GTTGCCGAC GCAACCAAAG GCGCACCTGC CGAAATCCGC

751 GAACAATTCA TGCTGGCTGC GGAAAACACG CTGAACATCT TTGCACAAAA

801 AGGCTATTTG GGATTGGACG AATTTATTAC GTCCAATATC CCGAAAGAGC

851 AGCAGGATAA GATGCAGGGC TATTTCTACG AAATGCTTTA CGGCGTGATG

901 AACGCTGCTT TGGATGAAAC CAT.ACCCGG TACGGCTTGC CCGAATGGCA

951 GCAGGATGAA GCGCGGAATC GTTTCCTGCT GCACAGTATG GATGCGTACA

1001 CGGGTTTGAC CGAATATCCC GCGCCTATGC TGCTGCAACT TGATGGGTTT

1051 TCCGAGGTGC GTTCGTCGGG TTTGCAGATG ACCCGTTCCC C.GGTCCGCT

1101 TTTGGTCTAT CTC...
```

This corresponds to the amino acid sequence <SEQ ID 328; ORF88>:

```
  1 MVFLNADNGI LVQDLPFEVK LKKFHIDFYN TGMPRDFASD IEVTDKATGE

51 KLERTIRVNH PLTLHGITIY QASFADGGSD LTFKAWNLGD ASREPVVLKA

101 TSIHQFPLEI GKHKYRLEFD QFTSMNVEDM SEGAEREKSL KSTLPDVRAV

151 TQEGHKYTNX XXXXXYRIRD APGQAVEYKN YMLPVLQEQD YFWITGTRSX

201 LQQQYRWLRI PLDKQLKADT FMALREFLKD GEGRKRXVAD ATKGAPAEIR

251 EQFMLAAENT LNIFAQKGYL GLDEFITSNI PKEQQDKMQG YFYEMLYGVM

301 NAALDETXTR YGLPEWQQDE ARNRFLLHSM DAYTGLTEYP APMLLQLDGF

351 SEVRSSGLQM TRSXGPLLVY L...
```

Further work revealed the complete nucleotide sequence
<SEQ ID 329>:

```
   1 ATGAGTAAAT CCCGTAGATC TCCCCCACTT CTTTCCCGTC CGTGGTTCGC
  51 TTTTTTCAGC TCCATGCGCT TTGCAGTCGC TTTGCTCAGT CTGCTGGGTA
 101 TTGCATCGGT TATCGGTACG GTGTTGCAGC AAAACCAGCC GCAGACGGAT
 151 TATTTGGTCA AATTCGGATC GTTTTGGGCG CAGATTTTTG GTTTTCTGGG
 201 ACTGTATGAC GTCTATGCTT CGGCATGGTT TGTCGTTATC ATGATGTTTT
 251 TGGTGGTTTC TACCAGTTTG TGCCTGATTC GCAATGTGCC GCCGTTCTGG
 301 CGCGAAATGA AGTCTTTTCG GGAAAAGGTT AAAGAAAAAT CTCTGGCGGC
 351 GATGCGCCAT TCTTCGCTGT TGGATGTAAA AATTGCGCCC GAGGTTGCCA
 401 AACGTTATCT GGAAGTACAA GGTTTTCAGG GAAAAACCAT TAACCGTGAA
 451 GACGGGTCGG TTCTGATTGC CGCCAAAAAA GGCACAATGA ACAAATGGGG
 501 CTATATCTTT GCCCATGTTG CTTTGATTGT CATTTGCCTG GGCGGGTTGA
 551 TAGACAGTAA CCTGCTGTTG AAACTGGGTA TGCTGACCGG TCGGATTGTT
 601 CCGGACAATC AGGCGGTTTA TGCCAAGGAT TTCAAGCCCG AAAGTATTTT
 651 GGGTGCGTCC AATCTCTCAT TTAGGGGCAA CGTCAATATT TCCGAGGGGC
 701 AGAGTGCGGA TGTGGTTTTC CTGAATGCCG ACAACGGGAT ATTGGTTCAG
 751 GACTTGCCTT TTGAAGTCAA ACTGAAAAAA TTCCATATCG ATTTTTACAA
 801 TACGGGTATG CCGCGTGATT TCGCCAGCGA TATTGAAGTG ACGGACAAGG
 851 CAACCGGTGA GAAACTCGAG CGCACCATCC GCGTGAACCA TCCTTTGACC
 901 TTGCACGGCA TCACGATTTA TCAGGCGAGT TTTGCCGACG GCGGTTCGGA
 951 TTTGACATTC AAGGCGTGGA ATTTGGGTGA TGCTTCGCGC GAGCCTGTCG
1001 TGTTGAAGGC AACATCCATA CACCAGTTTC CGTTGGAAAT TGGCAAACAC
1051 AAATATCGTC TTGAGTTCGA TCAGTTCACT TCTATGAATG TGGAGGACAT
1101 GAGCGAGGGC GCGGAACGGG AAAAAAGCCT GAAATCCACG CTGAACGATG
1151 TCCGCGCCGT TACTCAGGAA GGTAAAAAAT ACACCAATAT CGGCCCTTCC
1201 ATTGTTTACC GTATCCGTGA TGCGGCAGGG CAGGCGGTCG AATATAAAAA
1251 CTATATGCTG CCGGTTTTGC AGGAACAGGA TTATTTTTGG ATTACCGGCA
1301 CGCGCAGCGG CTTGCAGCAG CAATACCGCT GGCTGCGTAT CCCCTTGGAC
1351 AAGCAGTTGA AAGCGGACAC CTTTATGGCA TTGCGTGAGT TTTTGAAAGA
1401 TGGGGAAGGG CGCAAACGTC TGGTTGCCGA CGCAACCAAA GGCGCACCTG
1451 CCGAAATCCG CGAACAATTC ATGCTGGCTG CGGAAAACAC GCTGAACATC
1501 TTTGCACAAA AAGGCTATTT GGGATTGGAC GAATTTATTA CGTCCAATAT
1551 CCCGAAAGAG CAGCAGGATA AGATGCAGGG CTATTTCTAC GAAATGCTTT
1601 ACGGCGTGAT GAACGCTGCT TTGGATGAAA CCATACGCCG GTACGGCTTG
1651 CCCGAATGGC AGCAGGATGA AGCGCGGAAT CGTTTCCTGC TGCACAGTAT
1701 GGATGCGTAC ACGGGTTTGA CCGAATATCC CGCGCCTATG CTGCTGCAAC
1751 TTGATGGGTT TTCCGAGGTG CGTTCGTCGG GTTTGCAGAT GACCCGTTCC
1801 CCGGGTGCGC TTTTGGTCTA TCTCGGCTCG GTGCTGTTGG TATTGGGTAC
1851 GGTATTGATG TTTTATGTGC GCGAAAAACG GGCGTGGGTA TTGTTTTCAG
```

```
-continued
1901 ACGGCAAAAT CCGTTTTGCC ATGTCTTCGG CCCGCAGCGA ACGGGATTTG

1951 CAGAAGGAAT TTCCAAAACA CGTCGAGAGT CTGCAACGGC TCGGCAAGGA

2001 CTTGAATCAT GACTGA
```

This corresponds to the amino acid sequence <SEQ ID 330; ORF88-1>:

```
  1 MSKSRRSPPL LSRPWFAFFS SMRFAVALLS LLGIASVIGT VLQQNQPQTD

51 YLVKFGSFWA QIFGFLGLYD VYASAWFVVI MMFLVVSTSL CLIRNVPPFW

101 REMKSFREKV KEKSLAAMRH SSLLDVKIAP EVAKRYLEVQ GFQGKTINRE

151 DGSVLIAAKK GTMNKWGYIF AHVALIVICL GGLIDSNLLL KLGMLTGRIV

201 PDNQAVYAKD FKPESILGAS NLSFRGNVNI SEGQSADVVF LNADNGILVQ

251 DLPFEVKLKK FHIDFYNTGM PRDFASDIEV TDKATGEKLE RTIRVNHPLT

301 LHGITIYQAS FADGGSDLTF KAWNLGDASR EPVVLKATSI HQFPLEIGKH

351 KYRLEFDQFT SMNVEDMSEG AEREKSLKST LNDVRAVTQE GKKYTNIGPS

401 IVYRIRDAAG QAVEYKNYML PVLQEQDYFW ITGTRSGLQQ QYRWLRIPLD

451 KQLKADTFMA LREFLKDGEG RKRLVADATK GAPAEIREQF MLAAENTLNI

501 FAQKGYLGLD EFITSNIPKE QQDKMQGYFY EMLYGVMNAA LDETIRRYGL

551 PEWQQDEARN RFLLHSMDAY TGLTEYPAPM LLQLDGFSEV RSSGLQMTRS

601 PGALLVYLGS VLLVLGTVLM FYVREKRAWV LFSDGKIRFA MSSARSERDL

651 QKEFPKHVES LQRLGKDLNH D*
```

Computer analysis of this amino acid sequence gave the following results:

Homology with a Predicted ORF from *N. meningitidis* (Strain A)

ORF88 shows 95.7% identity over a 371aa overlap with an ORF (ORF88a) from strain A of *N. meningitidis*:

```
                                      10         20         30
orf88.pep                       MVFLNADNGILVQDLPFEVKLKKFHIDFYN
                                :|||||||||||||||||||||||||||||
orf88a    AKDFKPESILGASNLSFRGNVNISEGQSADVVFLNADNGILVQDLPFEVKLKKFHIDFYN
          210       220       230       240       250       260

40         50         60         70         80         90
orf88.pep TGMPRDFASDIEVTDKATGEKLERTIRVNHPLTLHGITIYQASFADGGSDLTFKAWNLGD
          ||||||||||||||||||||||||||||||||||||||||||||||||||||||||||||
orf88a    TGMPRDFASDIEVTDKATGEKLERTIRVNHPLTLHGITIYQASFADGGSDLTFKAWNLGD
          270       280       290       300       310       320

100       110       120       130       140       150
orf88.pep ASREPVVLKATSIHQFPLEIGKHKYRLEFDQFTSMNVEDMSEGAEREKSLKSTLPDVRAV
          |||||||||||||||||||||||||||||||||||||||||||||||||||| |||||||
orf88a    ASREPVVLKATSIHQFPLEIGKHKYRLEFDQFTSMNVEDMSEGAEREKSLKSTLNDVRAV
          330       340       350       360       370       380

160       170       180       190       200       210
orf88.pep TQEGHKYTNXXXXXXXYRIRDAPGQAVEYKNYMLPVLQEQDYFWITGTRSXLQQQYRWLRI
          ||||:||||       ||||||  |||||||||||||||||||||||||| |||||||||
orf88a    TQEGKKYTNIGPSIVYRIRDAAGQAVEYKNYMLPVLQEQDYFWITGTRSGLQQQYRWLRI
          390       400       410       420       430       440

220       230       240       250       260       270
orf88.pep PLDKQLKADTFMALREFLKDGEGRKRXVADATKGAPAEIREQFMLAAENTLNIFAQKGYL
          ||||||||||||||||||||||||||| ||||||||||||||||||||||||||||||||
orf88a    PLDKQLKADTFMALREFLKDGEGRKRLVADATKGAPAEIREQFMLAAENTLNIFAQKGYL
          450       460       470       480       490       500
```

```
              280        290        300        310        320        330
orf88.pep    GLDEFITSNIPKEQQDKMQGYFYEMLYGVMNAALDETXTRYGLPEWQQDEARNRFLLHSM
             ||||||||||||||||||||||||||||||||||||| ||||||||||||||||||||||
orf88a       GLDEFITSNIPKEQQDKMQGYFYEMLYGVMNAALDETIRRYGLPEWQQDEARNRFLLHSM
              510        520        530        540        550        560

340        350        360        370
orf88.pep    DAYTGLTEYPAPMLLQLDGFSEVRSSGLQMTRSXGPLLVYL
             |||||||||||||||||||||||||||||||||||| ||||
orf88a       DAYTGLTEYPAPMLLQLDGFSEVRSSGLQMTRSPGALLVYLGSVLLVLGTVLMFYVREKR
              570        580        590        600        610        620
orf88a       AWVLFSDGKIRFAMSSARSERDLQKEFPKHVESLQRLGKDLNHDX
              630        640        650        660        670
```

The complete length ORF88a nucleotide sequence <SEQ ID 331> is:

```
   1 ATGAGTAAAT CCCGTAGATC TCCCCCACTT CTTTCCCGTC CGTGGTTCGC
  51 TTTTTTCAGC TCCATGCGCT TTGCGGTCGC TTTGCTCAGT CTGCTGGGTA
 101 TTGCATCGGT TATCGGTACG GTGTTGCAGC AAAACCAGCC GCAGACGGAT
 151 TATTTGGTCA AATTCGGATC GTTTTGGGCG CAGATTTTTG GTTTTCTGGG
 201 ACTGTATGAC GTCTATGCTT CGGCATGGTT TGTCGTTATC ATGATGTTTT
 251 TGGTGGTTTC TACCAGTTTG TGCCTGATTC GCAATGTGCC GCCGTTCTGG
 301 CGCGAAATGA AGTCTTTTCG GGAAAAGGTT AAAGAAAAAT CTCTGGCGGC
 351 GATGCGCCAT TCTTCGCTGT GGATGTAAA AATTGCGCCC GAGGTTGCCA
 401 AACGTTATCT GGAAGTACAA GGTTTTCAGG GAAAAACCAT TAACCGTGAA
 451 GACGGGTCGG TTCTGATTGC CGCCAAAAAA GGCACAATGA ACAAATGGGG
 501 CTATATCTTT GCCCATGTTG CTTTGATTGT CATTTGCCTG GCGGGTTGA
 551 TAGACAGTAA CCTGCTGTTG AAACTGGGTA TGCTGACCGG TCGGATTGTT
 601 CCGGACAATC AGGCGGTTTA TGCCAAGGAT TTCAAGCCCG AAAGTATTTT
 651 GGGTGCGTCC AATCTCTCAT TTAGGGGCAA CGTCAATATT TCCGAGGGGC
 701 AGAGTGCGGA TGTGGTTTTC CTGAATGCCG ACAACGGGAT ATTGGTTCAG
 751 GACTTGCCTT TGAAGTCAA ACTGAAAAAA TTCCATATCG ATTTTTACAA
 801 TACGGGTATG CCGCGCGATT TGCCAGTGA TATTGAAGTA ACGGATAAGG
 851 CAACCGGTGA GAAACTCGAG CGCACCATCC GCGTGAACCA TCCTTTGACC
 901 TTGCACGGCA TCACGATTTA TCAGGCGAGT TTTGCCGACG GCGGTTCGGA
 951 TTTGACATTC AAGGCGTGGA ATTTGGGTGA TGCTTCGCGC GAGCCTGTCG
1001 TGTTGAAGGC AACATCCATA CACCAGTTTC CGTTGGAAAT TGGCAAACAC
1051 AAATATCGTC TTGAGTTCGA TCAGTTTACT TCTATGAATG TGGAGGACAT
1101 GAGCGAGGGC GCGGAACGGG AAAAAAGCCT GAAATCCACG CTGAACGATG
1151 TCCGCGCCGT TACTCAGGAA GGTAAAAAAT ACACCAATAT CGGCCCTTCC
1201 ATTGTTTACC GTATCCGTGA TGCGGCAGGG CAGGCGGTCG AATATAAAAA
1251 CTATATGCTG CCGGTTTTGC AGGAACAGGA TTATTTTTGG ATTACCGGCA
1301 CGCGCAGCGG CTTGCAGCAG CAATACCGCT GGCTGCGTAT CCCCTTGGAC
1351 AAGCAGTTGA AAGCGGACAC CTTTATGGCA TTGCGTGAGT TTTTGAAAGA
1401 TGGGGAAGGG CGCAAACGTC TGGTTGCCGA CGCAACCAAA GGCGCACCTG
1451 CCGAAATCCG CGAACAATTC ATGCTGGCTG CGGAAAACAC GCTCAACATC
```

```
1501 TTTGCACAAA AAGGCTATTT GGGATTGGAC GAATTTATTA CGTCCAATAT

1551 CCCGAAAGAG CAGCAGGATA AGATGCAGGG CTATTTCTAC GAAATGCTTT

1601 ACGGCGTGAT GAACGCTGCT TTGGATGAAA CCATACGCCG GTACGGCTTG

1651 CCCGAATGGC AGCAGGATGA AGCGCGGAAT CGTTTCCTGC TGCACAGTAT

1701 GGATGCGTAC ACGGGTTTGA CCGAATATCC CGCGCCTATG CTGCTGCAAC

1751 TTGATGGGTT TTCCGAGGTG CGTTCGTCGG GTTTGCAGAT GACCCGTTCC

1801 CCGGGTGCGC TTTTGGTCTA TCTCGGCTCG GTGCTGTTGG TATTGGGTAC

1851 GGTATTGATG TTTTATGTGC GCGAAAAACG GGCGTGGGTA TTGTTTTCAG

1901 ACGGCAAAAT CCGTTTTGCC ATGTCTTCGG CCCGCAGCGA ACGGGATTTG

1951 CAGAAGGAAT TTCCAAAACA CGTCGAGAGT CTGCAACGGC TCGGCAAGGA

2001 CTTGAATCAT GACTGA
```

This encodes a protein having amino acid sequence <SEQ ID 332>:

```
  1 MSKSRRSPPL LSRPWFAFFS SMRFAVALLS LLGIASVIGT VLQQNQPQTD
 51 YLVKFGSFWA QIFGFLGLYD VYASAWFVVI MNFLVVSTSL CLIRNVPPFW
101 REMKSFREKV KEKSLAAMRH SSLLDVKIAP EVAKRYLEVQ GFQGKTINRE
151 DGSVLIAAKK GTMNKWGYIF AHVALIVICL GGLIDSNLLL KLGMLTGRIV
201 PDNQAVYAKD FKPESILGAS NLSFRGNVNI SEGQSADVVF LNADNGILVQ
251 DLPFEVKLKK FHIDFYNTGM PRDFASDIEV TDKATGEKLE RTIRVNHPLT
301 LHGITIYQAS FADGGSDLTF KAWNLGDASR EPVVLKATSI HQFPLEIGKH
351 KYRLEFDQFT SMNVEDMSEG AEREKSLKST LNDVRAVTQE GKKYTNIGPS
401 IVYRIRDAAG QAVEYKNYML PVLQEQDYFW ITGTRSGLQQ QYRWLRIPLD
451 KQLKADTFMA LREFLKDGEG RKRLVADATK GAPAEIREQF MLAAENTLNI
501 FAQKGYLGLD EFITSNIPKE QQDKMQGYFY EMLYGVMNAA LDETIRRYGL
551 PEWQQDEARN RFLLHSMDAY TGLTEYPAPM LLQLDGFSEV RSSGLQMTRS
601 PGALLVYLGS VLLVLGTVLM FYVREKRAWV LFSDGKIRFA MSSARSERDL
651 QKEFPKHVES LQRLGKDLNH D*
```

ORF88a and ORF88-1 100.0% identity in 671 aa overlap:

```
orf88a.pep    MSKSRRSPPLLSRPWFAFFSSMRFAVALLSLLGIASVIGTVLQQNQPQTDYLVKFGSFWA    60
              ||||||||||||||||||||||||||||||||||||||||||||||||||||||||||||
orf88-1       MSKSRRSPPLLSRPWFAFFSSMRFAVALLSLLGIASVIGTVLQQNQPQTDYLVKFGSFWA    60 orf88a.pep    QIFGFLGLYDVYASAWFVVIMMFLVVSTSLCLIRNVPPFWREMKSFREKVKEKSLAAMRH   120
              ||||||||||||||||||||||||||||||||||||||||||||||||||||||||||||
orf88-1       QIFGFLGLYDVYASAWFVVIMMFLVVSTSLCLIRNVPPFWREMKSFREKVKEKSLAAMRH   120 orf88a.pep    SSLLDVKIAPEVAKRYLEVQGFQGKTINREDGSVLIAAKKGTMNKWGYIFAHVALIVICL   180
              ||||||||||||||||||||||||||||||||||||||||||||||||||||||||||||
orf88-1       SSLLDVKIAPEVAKRYLEVQGFQGKTINREDGSVLIAAKKGTMNKWGYIFAHVALIVICL   180 orf88a.pep    GGLIDSNLLLKLGMLTGRIVPDNQAVYAKDFKPESILGASNLSFRGNVNISEGQSADVVF   240
              ||||||||||||||||||||||||||||||||||||||||||||||||||||||||||||
orf88-1       GGLIDSNLLLKLGMLTGRIVPDNQAVYAKDFKPESILGASNLSFRGNVNISEGQSADVVF   240
```

```
                -continued
orf88a.pep  LNADNGILVQDLPFEVKLKKFHIDFYNTGMPRDFASDIEVTDKATGEKLERTIRVNHPLT  300
            ||||||||||||||||||||||||||||||||||||||||||||||||||||||||||||
orf88-1     LNADNGILVQDLPFEVKLKKFHIDFYNTGMPRDFASDIEVTDKATGEKLERTIRVNHPLT  300 orf88a.pep  LHGITIYQASFADGGSDLTFKAWNLGDASREPVVLKATSIHQFPLEIGKHKYRLEFDQFT  360
            ||||||||||||||||||||||||||||||||||||||||||||||||||||||||||||
orf88-1     LHGITIYQASFADGGSDLTFKAWNLGDASREPVVLKATSIHQFPLEIGKHKYRLEFDQFT  360 orf88a.pep  SMNVEDMSEGAEREKSLKSTLNDVRAVTQEGKKYTNIGPSIVYRIRDAAGQAVEYKNYML  420
            ||||||||||||||||||||||||||||||||||||||||||||||||||||||||||||
orf88-1     SMNVEDMSEGAEREKSLKSTLNDVRAVTQEGKKYTNIGPSIVYRIRDAAGQAVEYKNYML  420 orf88a.pep  PVLQEQDYFWITGTRSGLQQQYRWLRIPLDKQLKADTFMALREFLKDGEGRKRLVADATK  480
            ||||||||||||||||||||||||||||||||||||||||||||||||||||||||||||
orf88-1     PVLQEQDYFWITGTRSGLQQQYRWLRIPLDKQLKADTFMALREFLKDGEGRKRLVADATK  480 orf88a.pep  GAPAEIREQFMLAAENTLNIFAQKGYLGLDEFITSNIPKEQQDKMQGYFYEMLYGVMNAA  540
            ||||||||||||||||||||||||||||||||||||||||||||||||||||||||||||
orf88-1     GAPAEIREQFMLAAENTLNIFAQKGYLGLDEFITSNIPKEQQDKMQGYFYEMLYGVMNAA  540 orf88a.pep  LDETIRRYGLPEWQQDEARNRFLLHSMDAYTGLTEYPAPMLLQLDGFSEVRSSGLQMTRS  600
            ||||||||||||||||||||||||||||||||||||||||||||||||||||||||||||
orf88-1     LDETIRRYGLPEWQQDEARNRFLLHSMDAYTGLTEYPAPMLLQLDGFSEVRSSGLQMTRS  600 orf88a.pep  PGALLVYLGSVLLVLGTVLMFYVREKRAWVLFSDGKIRFAMSSARSERDLQKEFPKHVES  660
            ||||||||||||||||||||||||||||||||||||||||||||||||||||||||||||
orf88-1     PGALLVYLGSVLLVLGTVLMFYVREKRAWVLFSDGKIRFAMSSARSERDLQKEFPKHVES  660 orf88a.pep  LQRLGKDLNHD  672
            |||||||||||
orf88-1     LQRLGKDLNHD  672
```

Homology with a Predicted ORF from *N. gonorrhoeae*
ORF88 shows 93.8% identity over a 371aa overlap with a predicted ORF (ORF88.ng) from *N. gonorrhoeae*:

```
orf88.pep   MVFLNADNGILVQDLPFEVKLKKFHIDFYNTGMPRDFASDIEVTDKATGEKLERTIRVNH   60
            |||||||||:||||||||||||||||||||||||||||||||||||||||||||||||||
orf88ng     MVFLNADNGMLVQDLPFEVKLKKFHIDFYNTGMPRDFASDIEVTDKATGEKLERTIRVNH   60 orf88.pep   PLTLHGITIYQASFADGGSDLTFKAWNLGDASREPVVLKATSIHQFPLEIGKHKYRLEFD  120
            ||||||||||||||||||||||||||||||||||||||||||||||||||||||||||||
orf88ng     PLTLHGITIYQASFADGGSDLTFKAWNLRDASREPVVLKATSIHQFPLEIGKHKYRLEFD  120 orf88.pep   QFTSMNVEDMSEGAEREKSLKSTLPDVRAVTQEGHKYTNXXXXXXYRIRDAPGQAVEYKN  180
            |||||||||||||||||||||||| ||||||||:|||      ||||||  ||||||||
orf88ng     QFTSMNVEDMSEGAEREKSLKSTLNDVRAVTQEGKKYTNIGPSIVYRIRDAAGQAVEYKN  180 orf88.pep   YMLPVLQEQDYFWITGTRSXLQQQYRWLRIPLDKQLKADTFMALREFLKDGEGRKRXVAD  240
            ||||:||::||||:|||||  ||||||||||||||||||||||||||||||||||| ||
orf88ng     YMLPILQDKDYFWLTGTRSGLQQQYRWLRIPLDKQLKADTFMALREFLKDGEGRKRLVAD  240 orf88.pep   ATKGAPAEIREQFMLAAENTLNIFAQKGYLGLDEFITSNIPKEQQDKMQGYFYEMLYGVM  300
            ||| ||||||||||||||||||||||||||||||||||| ||||||||||||||||||||
orf88ng     ATKDAPAEIREQFMLAAENTLNIFAQKGYLGLDEFITSNIPKGQQDKMQGYFYEMLYGVM  300 orf88.pep   NAALDETXTRYGLPEWQQDEARNRFLLHSMDAYTGLTEYPAPMLLQLDGFSEVRSSGLQM  360
            |||||||  ||||||||||||||||||||||||||||||||||||||||||||||||||
orf88ng     NAALDETIRRYGLPEWQQDEARNRFLLHSMDAYTGLTEYPAPMLLQLDGFSEVRSSGLQM  360 orf88.pep   TRSXGPLLVYL                                                  371
            ||| | |||||
orf88ng     TRSPGALLVYLGSVLLVLGTVFMFYVPKKRAWVLFSNXKIRFAMSSARSERDLQKEFPKH  420
```

An ORF88ng nucleotide sequence <SEQ ID 333> was predicted to encode a protein having amino acid sequence <SEQ ID 334>:

```
  1 MVFLNADNGM LVQDLPFEVK LKKFHIDFYN TGMPRDFASD IEVTDKATGE

51 KLERTIRVNH PLTLHGITIY QASFADGGSD LTFKAWNLRD ASREPVVLKA

101 TSIHQFPLEI GKHKYRLEFD QFTSMNVEDM SEGAEREKSL KSTLNDVRAV
```

-continued

```
151 TQEGKKYTNI GPSIVYRIRD AAGQAVEYKN YMLPILQDKD YFWLTGTRSG

201 LQQQYRWLRI PLDKQLKADT FMALREFLKD GEGRKRLVAD ATKDAPAEIR

251 EQFMLAAENT LNIFAQKGYL GLDEFITSNI PKGQQDKMQG YFYEMLYGVM

301 NAALDETIRR YGLPEWQQDE ARNRFLLHSM DAYTGLTEYP APMLLQLDGF

351 SEVRSSGLQM TRSPGALLVY LGSVLLVLGT VFMFYVPKKR AWVLFSNXKI

401 RFAMSSARSE RDLQKEFPKH VESLQRLGKD LNHD*
```

Further work revealed the complete gonococcal DNA sequence <SEQ ID 335>:

```
   1 ATGAGTAAAT CCCGTATATC TCCCACACTT CTTTCCCGTC CGTGGTTCGC

51 TTTTTTCAGC TCCATGCGCT TTGCGGTCGC TTTGCTCAGT CTGCTGGGTA

101 TTGCATCGGT TATCGGCACG GTGTTACAGC AAAACCAGCC GCAGACGGAT

151 TATTTGGTCA AATTCGGACC GTTTTGGACT CGGATTTTTG ATTTTTTGGG

201 TTTGTATGAT GTCTATGCTT CGGCATGGTT TGTCGTTATC ATGATGTTTC

251 TGGTGGTTTC TACCAGTTTG TGTTTAATCC GTAACGTTCC GCCGTTTTGG

301 CGCGAAATGA AGTCTTTCCG GGAAAAGGTT AAAGAAAAAT CTCTGGCGGC

351 GATGCGCCAT TCTTCGCTGT GGATGTAAA AATTGCCCCC GAAGTTGCCA

401 AACGTTATCT GCAGGTGCGG GGTTTTCAGG GAAAAACCGT CAGCCGTGAG

451 GACGGGTCGG TTCTGATTGC CGCCAAAAAA GGCAcaatga acaaATGGGG

501 CTATATCTTT GCccaagtag ctTTGATTGT CATTTGCCTG GGCGGGTTGA

551 TAGACAGTAA CCTGCTGCTG AAGCTGGGTA TGCTGGCCGG TCGGATTGTT

601 CCGGACAATC AGGCGGTTTA TGCCAAGGAT TTCAAGCCCG AAAGTATTTT

651 GGGTGCGTCC AATCTCTCAT TTAGGGGCAA CGTCAATATT TCCGAGGGGC

701 AAAGTGCGGA TGTGGTTTTC CTGAATGCCG ACAACGGGAT GTTGGTTCAG

751 GACTTGCCTT TGAAGTCAA ACTGAAAAAA TTCCATATCG ATTTTTACAA

801 TACGGGTATG CCGCGCGATT TGCCAGCGA TATTGAAGTA ACGGACAAGG

851 CAACCGGTGA GAAACTCGAG CGCACCATCC GCGTGAACCA TCCTTTGACC

901 TTGCACGGCA TCACGATTTA TCAGGCGAGT TTTGCCGACG GCGGTTCGGA

951 TTTGACATTC AAGGCGTGGA ATTTGAGGGA TGCTTCGCGC GAACCTGTCG

1001 TGTTGAAGGC AACCTCCATA CACCAGTTTC CGTTGGAAAT CGGCAAACAC

1051 AAATATCGTC TTGAGTTCGA TCAGTTCACT TCTATGAATG TGGAGGACAT

1101 GAGCGAGGGT GCGGAACGGG AAAAAAGCCT GAAATCCACT CTGAACGATG

1151 TCCGCGCCGT TACTCAGGAA GGTAAAAAAT ACACCAATAT CGGCCCTTCC

1201 ATCGTGTACC GCATCCGTGA TGcggCAGGG CAGGCGGTCG AATATAAAAA

1251 CTATATGCTG CCGATTTTGC AGGACAAAGA TTATTTTTGG CTGACCGGCA

1301 CGCGCAGCGG CTTGCAGCAG CAATACCGCT GGCTGCGTAT CCCCTTGGAC

1351 AAGCAGTTGA AAGCGGACAC CTTTATGGCA TTGCGTGAGT TTTTGAAAGA

1401 TGGGGAAGGG CGCAAACGTC TGGTTGCCGA CGCAACCAAA GACGCACCTG

1451 CCGAAATCCG CGAACAATTC ATGCTGGCTG CGGAAAACAC GCTGAATATC

1501 TTTGCGCAAA AAGGCTATTT GGGATTGGAC GAATTTATTA CGTCCAATAT
```

```
1551 CCCGAAAGGG CAGCAGGATA AGATGCAGGG CTATTTCTAC GAAATGCTTT

1601 ACGGCGTGAT GAACGCTGCT TTGGATGAAA CCATACGCCG GTACGGCTTG

1651 CCCGAATGGC AGCAGGATGA AGCGCGGAAC CGTTTCCTGC TGCACAGTAT

1701 GGATGCCTAT ACGGGGCTGA CGGAATATCC CGCGCCTATG CTGCTCCAGC

1751 TTGACGGGTT TTCCGAGGTG CGTTCCTCAG GTTTGCAGAT GACCCGTTCG

1801 CCGGGTGCGC TTTTGGTCTA TCtcggctcg gtattgttgg TTTTGGgtac 1851 ggtaTttatg tTTTATGTGC GCGAAAAACG GGCGTGGgta tTGTTTTCag 1901 aCGGCAAAAT CCGTTTTGCT ATGtCTTCgg CCcgcagcga ACGGGATTTG 1951 cAGAaggaaT TTCCAAAACA CGtcgAGAGC CTGCAACggc tcggcaaggA 2001 CttaaaTCAT GACTga
```

This corresponds to the amino acid sequence <SEQ ID 336; ORF88ng-1>:

```
  1 MSKSRISPTL LSRPWFAFFS SMRFAVALLS LLGIASVIGT VLQQNQPQTD

51 YLVKFGPFWT RIFDFLGLYD VYASAWFVVI MMFLVVSTSL CLIRNVPPFW

101 REMKSFREKV KEKSLAAMRH SSLLDVKIAP EVAKRYLEVR GFQGKTVSRE

151 DGSVLIAAKK GTMNKWGYIF AQVALIVICL GGLIDSNLLL KLGMLAGRIV

201 PDNQAVYAKD FKPESILGAS NLSFRGNVNI SEGQSADVVF LNADNGMLVQ

251 DLPFEVKLKK FHIDFYNTGM PRDFASDIEV TDKATGEKLE RTIRVNHPLT

301 LHGITIYQAS FADGGSDLTF KAWNLRDASR EPVVLKATSI HQFPLEIGKH

351 KYRLEFDQFT SMNVEDMSEG AEREKSLKST LNDVRAVTQE GKKYTNIGPS

401 IVYRIRDAAG QAVEYKNYML PILQDKDYFW LTGTRSGLQQ QYRWLRIPLD

451 KQLKADTFMA LREFLKDGEG RKRLVADATK DAPAEIREQF MLAAENTLNI

501 FAQKGYLGLD EFITSNIPKG QQDKMQGYFY EMLYGVMNAA LDETIRRYGL

551 PEWQQDEARN RFLLHSMDAY TGLTEYPAPM LLQLDGFSEV RSSGLQMTRS

601 PGALLVYLGS VLLVLGTVFM FYVREKRAWV LFSDGKIRFA MSSARSERDL

651 QKEFPKHVES LQRLGKDLNH D*
```

ORF88ng-1 and ORF88-1 show 97.0% identity in 671 aa overlap:

```
orf88-1.pep    MSKSRRSPPLLSRPWFAFFSSMRFAVALLSLLGIASVIGTVLQQNQPQTDYLVKFGSFWA    60
               |||||  || |||||||||||||||||||||||||||||||||||||||||||||||| :
orf88ng-1      MSKSRISPTLLSRPWFAFFSSMRFAVALLSLLGIASVIGTVLQQNQPQTDYLVKFGPFWT    60 orf88-1.pep    QIFGFLGLYDVYASAWFVVIMMFLVVSTSLCLIRNVPPFWREMKSFREKVKEKSLAAMRH   120
               :|| ||||||||||||||||||||||||||||||||||||||||||||||||||||||||
orf88ng-1      RIFDFLGLYDVYASAWFVVIMMFLVVSTSLCLIRNVPPFWREMKSFREKVKEKSLAAMRH   120 orf88-1.pep    SSLLDVKIAPEVAKRYLEVQGFQGKTINREDGSVLIAAKKGTMNKWGYIFAHVALIVICL   180
               ||||||||||||||||||||:||||||::||||||||||||||||||||||:||||||||
orf88ng-1      SSLLDVKIAPEVAKRYLEVRGFQGKTVSREDGSVLIAAKKGTMNKWGYIFAQVALIVICL   180 orf88-1.pep    GGLIDSNLLLKLGMLTGRIVPDNQAVYAKDFKPESILGASNLSFRGNVNISEGQSADVVF   240
               |||||||||||||||| :||||||||||||||||||||||||||||||||||||||||||
orf88ng-1      GGLIDSNLLLKLGMLAGRIVPDNQAVYAKDFKPESILGASNLSFRGNVNISEGQSADVVF   240
```

```
                         -continued
orf88-1.pep   LNADNGILVQDLPFEVKLKKFHIDFYNTGMPRDFASDIEVTDKATGEKLERTIRVNHPLT   300
              |||||:||||||||||||||||||||||||||||||||||||||||||||||||||||
orf88ng-1     LNADNGMLVQDLPFEVKLKKFHIDFYNTGMPRDFASDIEVTDKATGEKLERTIRVNHPLT   300 orf88-1.pep   LHGITIYQASFADGGSDLTFKAWNLGDASREPVVLKATSIHQFPLEIGKHKYRLEFDQFT   360
              ||||||||||||||||||||||||||| ||||||||||||||||||||||||||||||||
orf88ng-1     LHGITIYQASFADGGSDLTFKAWNLRDASREPVVLKATSIHQFPLEIGKHKYRLEFDQFT   360 orf88-1.pep   SMNVEDMSEGAEREKSLKSTLNDVRAVTQEGKKYTNIGPSIVYRIRDAAGQAVEYKNYML   420
              ||||||||||||||||||||||||||||||||||||||||||||||||||||||||||||
orf88ng-1     SMNVEDMSEGAEREKSLKSTLNDVRAVTQEGKKYTNIGPSIVYRIRDAAGQAVEYKNYML   420 orf88-1.pep   PVLQEQDYFWITGTRSGLQQQYRWLRIPLDKQLKADTFMALREFLKDGEGRKRLVADATK   480
              |:||::||||:|||||||||||||||||||||||||||||||||||||||||||||||||
orf88ng-1     PILQKDYFWLTGTRSGLQQQYRWLRIPLDKQLKADTFMALREFLKDGEGRKRLVADATK   480 orf88-1.pep   GAPAEIREQFMLAAENTLNIFAQKGYLGLDEFITSNIPKEQQDKMQGYFYEMLYGVMNAA   540
              :|||||||||||||||||||||||||||||||||||| ||||||||||||||||||||||
orf88ng-1     DAPAEIREQFMLAAENTLNIFAQKGYLGLDEFITSNIPKGQQDKMQGYFYEMLYGVMNAA   540 orf88-1.pep   LDETIRRYGLPEWQQDEARNRFLLHSMDAYTGLTEYPAPMLLQLDGFSEVRSSGLQMTRS   600
              ||||||||||||||||||||||||||||||||||||||||||||||||||||||||||||
orf88ng-1     LDETIRRYGLPEWQQDEARNRFLLHSMDAYTGLTEYPAPMLLQLDGFSEVRSSGLQMTRS   600 orf88-1.pep   PGALLVYLGSVLLVLGTVLMFYVREKRAWVLFSDGKIRFAMSSARSERDLQKEFPKHVES   660
              |||||||||||||||||||:||||||||||||||||||||||||||||||||||||||||
orf88ng-1     PGALLVYLGSVLLVLGTVFMFYVREKRAWVLFSDGKIRFAMSSARSERDLQKEFPKHVES   660 orf88-1.pep   LQRLGKDLNHD   671
              |||||||||||
orf88ng-1     LQRLGKDLNHD   671
```

Furthermore, ORG88ng-1 shows homology with a hypothetical protein from *Aquifex aeolicus*:

```
gi|2984296 (AE000771) hypothetical protein [Aquifex aeolicus]
Length = 537
Score = 94.4 bits (231), Expect = 2e - 18.
Identities = 91/334 (27%), Positives = 159/334 (47%), Gaps = 59/334 (17%)

Query:   16 FAFFSSMRFAVALLSLLGIASVIG-TVLQQNQPQTDYLVKFGPFWTRIFDFLGLYDVYAS    74
            + F +S++ A+ ++ +LGI S++G T ++QNQ     YL +FG       L L DV+ S
Sbjct:   80 YDFLASLKLAIFIMLVLGILSMLGSTYIKQNQSFEWYLDQFGYDVGIWIWKLWLNDVFHS   139

Query:   75 AWFVVIMMFLVVSTSLCLIRNVPPFWREMKSFREKVKEKSLAAMRHSSLLDVKIAPEVAK   134
            ++++ ++ L V+    C I+ +P W++  S +E++ +    A +H  + VKI P+ K
Sbjct:  140 WYYILFIVLLAVNLIFCSIKRLPRVWKQAFS-KERILKLDEHAEKHLKPITVKI-PDKDK   197

Query:  135 --RYLEVRGFQGKTVSREDGSVLIAAKKGTMNKWGYIFAQVALIVICLGGLIDSNLLLKL   192
              ++L +GF+     V E  + + A+KG  ++ G   +AL+VI  G LID
Sbjct:  198 VLKFLLKKGFK-VFVEEEGNKLYVFAEKGRFSRLGVYITHIALLVIMAGALID-------   249

Query:  193 GMLAGRIVPDNQAVYAKDFKPESILGASNLSFRGNVNISEGQSADVVFLNADNGMLVQDL   252
                                +I+G     RG++ ++EG + DV+ + A+        L
Sbjct:  250 ---------------------AIVGV-----RGSLIVAEGDTNDVMLVGAE--QKPYKL   280

Query:  253 PFEVKLKKFHIDFY---NTGMPRDFA-------SDIEVTDKATGEKLER--TIRVNHPLT   300
            PF V L  F I Y    N + FA        SDIE+ +   G K+E  T++VN P
Sbjct:  281 PFAVHLIDFRIKTYAEENPNVDKRFAQAVSSYESDIEIIN---GGKVEAKGTVKVNEPFD   337

Query:  301 LHGITIYQASFA--DGGSDLTFKAWNLRDASREP                            332
             ++QA++   DG S +     + A +P
Sbjct:  338 FGRYRLFQATYGILDGTSGMGVIVVDRKKAHEDP                            371
```

Based on this analysis, including the putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 40

The following DNA sequence, believed to be complete, was identified in *N. meningitidis* <SEQ ID 337>:

```
  1 MMSNKMEQKG FTLIEMMIVV AILGIISVIA IPSYQSYIEK
    GYQSQLYTEM
 51 VGINNISKQF ILKNPLDDNQ TIENKLEIFV SGYKMNPKIA
    KKYSVSVKFV
101 DKEKSRAYRL VGVPKAGTGY TLSVWMNSVG DGYKCRDAAS
    AQAHLETLSS
151 DVGCEAESNR KK*
```

```
  1 ATGATGAGTA ATAmAATGGm ACAAAAAGGG TTTACATTGA TTGmGmTGAT
 51 GATAGTCGTC GCGATACTCG GCATTATCAG CGTCATTGCC ATACCTTCTT
101 ATCmAAGTTA TATTGAAAAA GGCTATCAGT CCCAGCTTTA TACGGAGATG
151 GyCGGTATCA ACAATATTTC CAAACAGTTT ATTTTGAAAA ATCCCCTGGA
201 CGATAATCAG ACCATCGAGA ACAAACTGGA AATATTTGTC TCAGGCTATA
251 AGATGAATCC GAAAATTGCC AAAAAaTATA GTGTTTCGGT AAAGTTTGTC
301 GATAAGGAAA AATCAAGGGC ATACAGGTTG GTCGGCGTTC CGAAGGCGGG
351 GACGGGTTAT ACTTTGTCGG TATGGATGAA CAGCGTGGGC GACGGATACA
401 AATGCCGTGA TGCCGCTTCT GCCCAAGCCC ATTTGGAGAC CTTGTCCTCA
451 GATGTCGGCT GTGAAGCCTT CTCTAATCGT AAAAAATAA
```

This corresponds to the amino acid sequence <SEQ ID 338; ORF89>:

```
  1 MMSNXMXQKG FTLIXXMIVV AILGIISVIA IPSYXSYIEK GYQSQLYTEM
 51 XGINNISKQF ILKNPLDDNQ TIENKLEIFV SGYKMNPKIA KKYSVSVKFV
101 DKEKSRAYRL VGVPKAGTGY TLSVWMNSVG DGYKCRDAAS AQAHLETLSS
151 DVGCEAFSNR KK*
```

Further work revealed the complete nucleotide sequence <SEQ ID 339>:

```
  1 ATGATGAGTA ATAAAATGGA ACAAAAAGGG TTTACATTGA TTGAGATGAT
 51 GATAGTCGTC GCGATACTCG GCATTATCAG CGTCATTGCC ATACCTTCTT
101 ATCAAAGTTA TATTGAAAAA GGCTATCAGT CCCAGCTTTA TACGGAGATG
151 GTCGGTATCA ACAATATTTC CAAACAGTTT ATTTTGAAAA ATCCCCTGGA
201 CGATAATCAG ACCATCGAGA ACAAACTGGA AATATTTGTC TCAGGCTATA
251 AGATGAATCC GAAAATTGCC AAAAAATATA GTGTTTCGGT AAAGTTTGTC
301 GATAAGGAAA AATCAAGGGC ATACAGGTTG GTCGGCGTTC CGAAGGCGGG
351 GACGGGTTAT ACTTTGTCGG TATGGATGAA CAGCGTGGGC GACGGATACA
401 AATGCCGTGA TGCCGCTTCT GCCCAAGCCC ATTTGGAGAC CTTGTCCTCA
451 GATGTCGGCT GTGAAGCCTT CTCTAATCGT AAAAAATAA
```

This corresponds to the amino acid sequence <SEQ ID 340; ORF89-1>:

Computer analysis of this amino acid sequence gave the following results:

Homology with PilE of *N. gonorrhoeae* (Accession Number Z69260).

ORF89 and PilE protein show 30% aa identity in 120a overlap:

```
orf89   8 QKGFTLIXXMIVVAILGIISVIAIPSYXSYIEKGYQSQLYTEMXGINNISKQFILKNPL-  66
          QKGFTLI  MIV+AI+GI++ +A+P+Y  Y +   S+      G  +  ++ L + +
PilE    5 QKGFTLIELMIVIAIVGILAAVALPAYQDYTARAQVSEAILLAEGQKSAVTEYYLNHGIW  64 orf89  67 -DDNQTIENKLEIFVSGYKMNPKIAKKYSVSVKFVDKEKSRAYRLVGVPKAGTGYTLSVW  125
            DN +        +G   +KI  KY  SV       +      GV K   G  LS+W
PilE   65 PKDNTS---------AGVASSDKIKGKYVQSVTVAKGVVTAEMASTGVNKEIQGKKLSLW  115
```

Homology with a Predicted ORF from *N. meningitidis* (Strain A)

ORF89 shows 83.3% identity over a 162aa overlap with an ORF (ORF89a) from strain A of *N. meningitidis*:

```
                    10        20        30        40        50        60
orf89.pep  MMSNXMXQKGFTLIXXMIVVAILGIISVIAIPSYXSYIEKGYQSQLYTEMXGINNISKQF
           ||||  |  ||||||||||    ||   |||      ||||||||||||||||  ||||||||
orf89a     MMSNKMEQKGFTLIXXXXXXAIXXXXSVIXXXXYXSYIEKGYQSQLYTEMVGINNISKQX
                    10        20        30        40        50        60
                    70        80        90       100       110       120
orf89.pep  ILKNPLDDNQTIENKLEIFVSGYKMNPKIAKKYSVSVKFVDKEKSRAYRLVGVPKAGTGY
           ||||||||||||::||||||||||||||||||:|:|||:|::||  |||  ||||||:||||
orf89a     ILKNPLDDNQTIKSKLEIFVSGYKMNPKIAEKYNVSVHFVNEEKPRAYSLVGVPKTGTGY
                    70        80        90       100       110       120
                   130       140       150       160
orf89.pep  TLSVWMNSVGDGYKCRDAASAQAHLETLSSDVGCEAFSNRKKX
           ||||||||||||||||||||||:||||||||||||||||||||
orf89a     TLSVWMNSVGDGYKCRDAASARAHLETLSSDVGCEAFSNRKKX
                   130       140       150       160
```

The complete length ORF89a nucleotide sequence <SEQ ID 341> is:

```
  1 ATGATGAGTA ATAAAATGGA ACAAAAAGGG TTTACATTGA
    TTGNGANGNT

51 NATNGNCNTC GCGATACNCN GCNTTANCAG CGTCATTNCN
    ATNNNTNCNT

101 ATCNNAGTTA TATTGAAAAA GGCTATCAGT CCCAGCTTTA
    TACGGAGATG

151 GTCGGTATCA ACAATATTTC CAAACAGTNT ATTTTGAAAA
    ATCCCCTGGA

201 CGATAATCAG ACCATCAAGA GCAAACTGGA AATATTTGTC
    TCAGGCTATA

251 AGATGAATCC GAAAATTGCC GAAAAATATA ATGTTTCGGT
    GCATTTTGTC

301 AATGAGGAAA AACCNAGGGC ATACAGCTTG GTCGGCGTTC
    CAAAGACGGG

351 GACGGGTTAT ACTTTGTCGG TATGGATGAA CAGCGTGGGC
    GACGGATACA

401 AATGCCGTGA TGCCGCTTCT GCCCGAGCCC ATTTGGAGAC
    CTTGTCCTCA

451 GATGTCGGCT GTGAAGCCTT CTCTAATCGT AAAAAATAG
```

This encodes a protein having amino acid sequence <SEQ ID 342>:

```
  1 MMSNKMEQKG FTLIXXXXXX AIXXXXSVIX XXXYXSYIEK
    GYQSQLYTEM

51 VGINNISKQX ILKNPLDDNQ TIKSKLEIFV SGYKMNPKIA
    EKYNVSVHFV

101 NEEKPRAYSL VGVPKTGTGY TLSVWMNSVG DGYKCRDAAS
    ARAHLETLSS

151 DVGCEAFSNR KK*
```

ORF89a and ORF89-1 show 83.3% identity in 162 aa overlap:

```
                    10         20         30         40         50         60
orf89a.pep  MMSNKMEQKGFTLIXXXXXXAIXXXXSVIXXXXXYXSYIEKGYQSQLYTEMVGINNISKQX
            ||||||||||||||   ||   |||     |  |||||||||||||||||||||||||||
orf89-1     MMSNKMEQKGFTLIEMMIVVAILGIISVIAIPSYQSYIEKGYQSQLYTEMVGINNISKQF
                    10         20         30         40         50         60
                    70         80         90        100        110        120
orf89a.pep  ILKNPLDDNQTIKSKLEIFVSGYKMNPKIAEKYNVSVHFVNEEKPRAYSLVGVPKTGTY
            ||||||||||||::||||||||||||||||:|||:|||::||   ||||||:||||
orf89-1     ILKNPLDDNQTIENKLEIFVSGYKMNPKIAKKYSVSVKFVDKEKSRAYRLVGVPKAGTGY
                    70         80         90        100        110        120
                   130        140        150        160
orf89a.pep  TLSVWMNSVGDGYKCRDAASARAHLETLSSDVGCEAFSNRKKX
            |||||||||||||||||||||:||||||||||||||||||||
orf89-1     TLSVWMNSVGDGYKCRDAASAQAHLETLSSDVGCEAFSNRKKX
                   130        140        150        160
```

Homology with a Predicted ORF from *N. gonorrhoeae*

ORF89 shows 84.6% identity over a 162aa overlap with a predicted ORF (ORF89.ng) from *N. gonorrhoeae*:

```
orf89    MMSNXMXQKGFTLIXXMIVVAILGIISVIAIPSYXSYIEKGYQSQLYTEMXGINNISKQF   60
         ||||  |||||||   |  :|||||||||||||| ||||||||||||||| ||||| |||
orf89ng  MMSNKMEQKGFTLIEMMIVVTILGIISVIAIPSYQSYIEKGYQSQLYTEMVGINNVLKQF   60
orf89    ILKNPLDDNQTIENKLEIFVSGYKMNPKIAKKYSVSVKFVDKEKSRAYRLVGVPKAGTGY  120
         ||||| |:|::::||:|||||||||||||||||||||:||:|||||||||||||:||||
orf89ng  ILKNPQDDNDTLKSKLKIFVSGYKMNPKIAKKYSVSVRFVDAEKPRAYRLVGVPNAGTGY  120
orf89    TLSVWMNSVGDGYKCRDAASAQAHLETLSSDVGCEAFSNRKK  162
         |||||||||||||||||||:||| : :|| :|||||||||||
orf89ng  TLSVWMNSVGDGYKCRDATSAQAYSDTLSADSGCEAFSNRKK  162
```

The complete length ORF89ng nucleotide sequence <SEQ ID 343> is:

```
  1 aTGATGAGCA ATAAAATGGA ACAAAAAGGG TTTACATTGA
    TTGAGATGAT
 51 GATAGTTGTC ACGATACTCG GCATCATCAG CGTCATTGCC
    ATACCTTCTT
101 ATCAGAGTTA TATTGAAAAA GGCTATCAGT CCCAGCTTTA
    TACGGAGATG
151 GTCGGTATCA ACAATGTTCT CAAACAGTTT ATTTTGAAAA
    ATCCCCAGGA
201 CGATAATGAT ACCCTCAAGA GCAAACTGAA AATATTTGTC
    TCAGGCTATA
251 AGATGAATCC GAAAATtgCC AAAAAATATA GTGTTTCGGt
    aaggtttGTC
301 gatGCGGAAA AACCAAGGGC ATACAGGTTG GTCGGCGTTC
    CGAACGCGGG
351 GACGGGTTAT ACTTTGTCGG TATGGATGAA CAGCGTGGGC
    GACGGATACA
401 AATGCCGTGA TGCCACTTCT GCCCAGGCCT ATTCGGACAC
    CTTGTCCGCA
451 GATAGCGGCT GTGAAGCTTT CTCTAATCGT AAAAAATAG
```

This encodes a protein having amino acid sequence <SEQ ID 344>:

```
  1 MMSNKMEQKG FTLIEMMIVV TILGIISVIA IPSYQSYIEK
    GYQSQLYTEM

51 VGINNVLKQF ILKNPQDDND TLKSKLKIFV SGYKMNPKIA
    KKYSVSVRFV

101 DAEKPRAYRL VGVPNAGTGY TLSVWMNSVG DGYKCRDATS
    AQAYSDTLSA

151 DSGCEAFSNR KK*
```

(First 30 residues underlined; residues 1-7 MMSNKME double-underlined)

This gonococcal protein has a putative leader peptide (underlined) and N-terminal methylation site (NMePhe or type-4 pili, double-underlined). In addition, ORF89ng and ORF89-1 show 88.3% identity in 162 aa overlap:

```
                     10         20         30         40         50         60
orf89-1.pep  MMSNKMEQKGFTLIEMMIVVAILGIISVIAIPSYQSYIEKGYQSQLYTEMVGINNISKQF
             ||||||||||||||||||||:||||||||||||||||||||||||||||||||||: |||
orf89ng      MMSNKMEQKGFTLIEMMIVVTILGIISVIAIPSYQSYIEKGYQSQLYTEMVGINNVLKQF
                     10         20         30         40         50         60
```

-continued
```
                        70         80         90        100        110        120
orf89-1.pep   ILKNPLDDNQTIENKLEIFVSGYKMNPKIAKKYSVSVKFVDKEKSRAYRLVGVPKAGTGY
              ||||  |||:|:::||:||||||||||||||||||||:|||  ||||||||||:||||
orf89ng       ILKNPQDDNDTLKSKLKIFVSGYKMNPKIAKKYSVSVRFVDAEKPRAYRLVGVPNAGTGY
                        70         80         90        100        110        120

130        140        150        160
orf89-1.pep   TLSVWMNSVGDGYKCRDAASAQAHLETLSSDVGCEAFSNRKKX
              |||||||||||||||||||:||||::||:|:|||||||||||
orf89ng       TLSVWMNSVGDGYKCRDATSAQAYSDTLSADSGCEAFSNRKKX
                       130        140        150        160
```

Based on this analysis, including the gonococcal motifs and the homology with the known PilE protein, it was predicted that these proteins from *N. meningitidis* and *N. gonorrhoeae*, and their epitopes, could be useful antigens for vaccines or diagnostics, or for raising antibodies.

Figure 11:
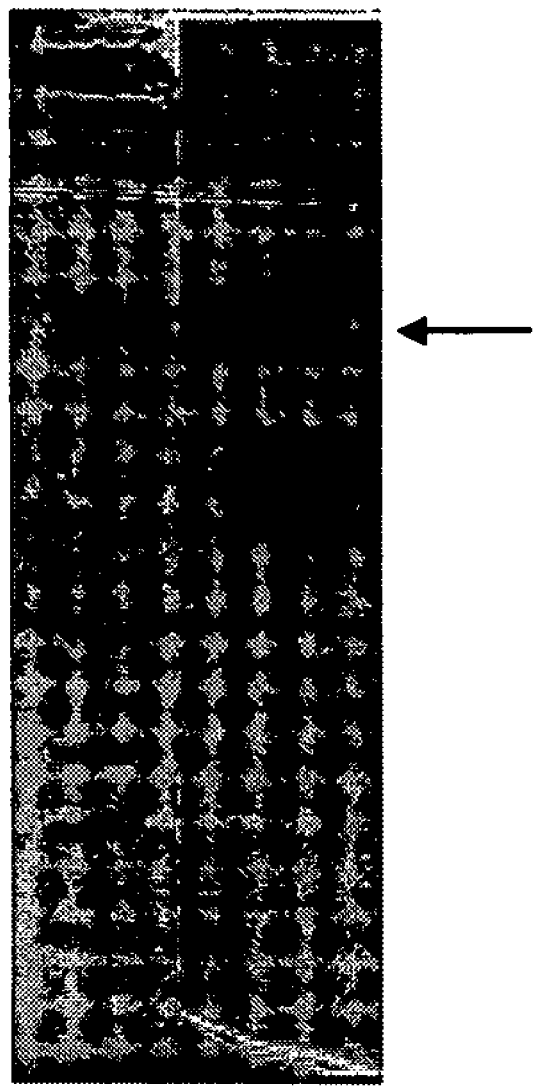

ORF89-1 (13.6 kDa) was cloned in the pGex vector and expressed in *E. coli*, as described above. The products of protein expression and purification were analyzed by SDS-PAGE. FIG. 11A shows the results of affinity purification of the GST-fusion protein. Purified GST-fusion protein was used to immunise mice, whose sera gave a positive result in the ELISA test, confirming that ORF89-1 is a surface-exposed protein, and that it is a useful immunogen.

Example 41

The following partial DNA sequence was identified in *N. meningitidis* <SEQ ID 345>:

```
  1 ATGAAAAAAT CCTCCCTCAT CAGCGCATTG GGCATCGGTA
    TTTTGAGCAT

51 CGGCATGGCA TTTGCCGCCC CTGCCGACGC GGTAAGCCAA
    ATCCGTCAAA

101 ACGCCACTCA AGTATTGAGC ATCTTAAAAA ACGGCGATGC
    CAACACCGCT

151 CGCCAAAAAG CCGAAGCCTA TGCGATTCCC TATTTCGATT
    TCCAACGTAT

201 GACCGCATTG GCGGTCGGCA ACCCTTGGsG CACCG.GTCC
    GACG.GCAAA

251 AACAAGCGTT GGCCn.AGAA TTTCAACCC . . .
```

This corresponds to the amino acid sequence <SEQ ID 346; ORF91>:

```
  1 MKKSSLISAL GIGILSIGMA FAAPADAVSQ IRQNATQVLS
    ILKNGDANTA

51 RQKAEAYAIP YFDFQRMTAL AVGNPWXTXS DXQKQALAXE
    FQP . . .
```

Further work revealed the complete nucleotide sequence <SEQ ID 347>:

```
  1 ATGAAAAAAT CCTCCCTCAT CAGCGCATTG GGCATCGGTA
    TTTTGAGCAT

51 CGGCATGGCA TTTGCCGCCC CTGCCGACGC GGTAAGCCAA
    ATCCGTCAAA

101 ACGCCACTCA AGTATTGAGC ATCTTAAAAA ACGGCGATGC
    CAACACCGCT

151 CGCCAAAAAG CCGAAGCCTA TGCGATTCCC TATTTCGATT
    TCCAACGTAT

201 GACCGCATTG GCGGTCGGCA ACCCTTGGCG CACCGCGTCC
    GACGCGCAAA

251 AACAAGCGTT GGCCAAAGAA TTTCAAACCC TGCTGATCCG
    CACCTATTCC

301 GGCACGATGC TGAAATTAAA AAACGCCAAC GTCAACGTCA
    AAGACAATCC

351 CATCGTCAAT AAAGGCGGCA AAGAAATCAT CGTCCGCGCC
    GAAGTCGGCG

401 TACCCGGGCA AAAACCCGTC AACATGGACT TCACCACCTA
    CCAAAGCGGC

451 GGTAAATACC GTACCTACAA CGTCGCCATC GAAGGCGCGA
    GCCTGGTTAC

501 CGTGTACCGC AACCAATTCG GCGAAATTAT CAAAGCGAAA
    GGCGTGGACG

551 GACTGATTGC CGAGTTGAAA GCCAAAAACG GCGGCAAATA
    A
```

This corresponds to the amino acid sequence <SEQ ID 348; ORF91-1>:

```
  1 MKKSSLISAL GIGILSIGMA FAAPADAVSQ IRQNATQVLS
    ILKNGDANTA

51 RQKAEAYAIP YFDFQRMTAL AVGNPWRTAS DAQKQALAKE
    FQTLLIRTYS

101 GTMLKLKNAN VNVKDNPIVN KGGKEIIVRA EVGVPGQKPV
    NMDFTTYQSG

151 GKYRTYNVAI EGASLVTVYR NQFGEIIKAK GVDGLIAELK
    AKNGGK*
```

Computer analysis of this amino acid sequence gave the following results:

Homology with a Predicted ORF from *N. meningitidis* (Strain A)

ORF91 shows 92.4% identity over a 92aa overlap with an ORF (ORF91a) from strain A of *N. meningitidis*:

```
                10         20         30         40         50         60
orf91.pep  MKKSSLISALGIGILSIGMAFAAPADAVSQIRQNATQVLSILKNGDANTARQKAEAYAIP
           |||||:||||||||||||||||||||||||:||||||||||:||||||||||||||||||
orf91a     MKKSSFISALGIGILSIGMAFAAPADAVNQIRQNATQVLSILKSGDANTARQKAEAYAIP
                10         20         30         40         50         60
                70         80         90
orf91.pep  YFDFQRMTALAVGNPWXTXSDXQKQALAXEFQP
           |||||||||||||||| | ||:|||||| ||||
orf91a     YFDFQRMTALAVGNPWRTASDAQKQALAKEFQTLLIRTYSGTMLKLKNANVNVKDNPIVN
                70         80         90        100        110        120
               130        140        150        160        170        180
orf91a     KGGKEIIVRAEVGVPGQKPVNMDFTTYQSGGKYRTYNVAIEGASLVTVYRNQFGEIIKAK
               130        140        150        160        170        180
```

The complete length ORF91a nucleotide sequence <SEQ ID 349> is:

```
  1 ATGAAAAAAT CCTCCTTCAT CAGCGCATTG GGCATCGGTA TTTTGAGCAT
 51 CGGCATGGCA TTTGCCGCCC CTGCCGACGC GGTAAACCAA ATCCGTCAAA
101 ACGCCACTCA AGTATTGAGC ATCTTAAAAA GCGGTGATGC CAACACCGCC
151 CGCCAAAAAG CCGAAGCCTA TGCGATTCCC TATTTCGATT TCCAACGTAT
201 GACCGCATTG GCGGTCGGCA ACCCTTGGCG CACCGCGTCC GACGCGCAAA
251 AACAAGCGTT GGCCAAAGAA TTTCAAACCC TGCTGATCCG CACCTATTCC
301 GGCACGATGC TGAAATTAAA AAACGCCAAC GTCAACGTCA AGACAATCC
351 CATCGTCAAT AAAGGCGGCA AGAAATCAT CGTCCGCGCC GAAGTCGGCG
401 TACCCGGGCA AAAACCCGTC AACATGGACT TCACCACCTA CCAAAGCGGC
451 GGTAAATACC GTACCTACAA CGTCGCCATC GAAGGCGCGA GCCTGGTTAC
501 CGTGTACCGC AACCAATTCG GCGAAATTAT CAAAGCGAAA GGCGTGGACG
551 GACTGATTGC CGAGTTGAAG CTAAAAACG GCAGCAAGTA A
```

This encodes a protein having amino acid sequence <SEQ ID 350>:

```
  1 MKKSSFISAL GIGILSIGMA FAAPADAVNQ IRQNATQVLS ILKSGDANTA
 51 RQKAEAYAIP YFDFQRMTAL AVGNPWRTAS DAQKQALAKE FQTLLIRTYS
101 GTMLKLKNAN VNVKDNPIVN KGGKEIIVRA EVGVPGQKPV NMDFTTYQSG
151 GKYRTYNVAI EGASLVTVYR NQFGEIIKAK GVDGLIAELK AKNGSK*
```

ORF91a and ORF91-1 show 98.0% identity in 196 aa overlap:

```
                10         20         30         40         50         60
orf91a.pep MKKSSFISALGIGILSIGMAFAAPADAVNQIRQNATQVLSILKSGDANTARQKAEAYAIP
           |||||:||||||||||||||||||||||||:||||||||||:||||||||||||||||||
orf91-1    MKKSSLISALGIGILSIGMAFAAPADAVSQIRQNATQVLSILKNGDANTARQKAEAYAIP
                10         20         30         40         50         60
                70         80         90        100        110        120
orf91a.pep YFDFQRMTALAVGNPWRTASDAQKQALAKEFQTLLIRTYSGTMLKLKNANVNVKDNPIVN
           ||||||||||||||||||||||||||||||||||||||||||||||||||||||||||||
orf91-1    YFDFQRMTALAVGNPWRTASDAQKQALAKEFQTLLIRTYSGTMLKLKNANVNVKDNPIVN
                70         80         90        100        110        120
               130        140        150        160        170        180
orf91a.pep KGGKEIIVRAEVGVPGQKPVNMDFTTYQSGGKYRTYNVAIEGASLVTVYRNQFGEIIKAK
           ||||||||||||||||||||||||||||||||||||||||||||||||||||||||||||
orf91-1    KGGKEIIVRAEVGVPGQKPVNMDFTTYQSGGKYRTYNVAIEGASLVTVYRNQFGEIIKAK
               130        140        150        160        170        180
```

-continued

```
                   190
orf91a.pep   GVDGLIAELKAKNGSKX
             |||||||||||||||:||
orf91-1      GVDGLIAELKAKNGGKX
                   190
```

Homology with a Predicted ORF from *N. gonorrhoeae*
ORF91 shows 84.8% identity over a 92aa overlap with a 10 predicted ORF (ORF91.ng) from *N. gonorrhoeae*:

```
orf91.pep   MKKSSLISALGIGILSIGMAFAAPADAVSQIRQNATQVLSILKNGDANTARQKAEAYAIP   60
            :||||:||||||||||||||||:|||||:||||||||||:||:|||:|||||||||:|
orf91ng     VKKSSFISALGIGILSIGMAFASPADAVGQIRQNATQVLTILKSGDAASARPKAEAYAVP   60 orf91.pep   YFDFQRMTALAVGNPWXTXSDXQKQALAXEFQP                              93
            |||||||||||||||| || ||  ||||| ||
orf91ng     YFDFQRMTALAVGNPWRTASDAQKQALAKEFQTLLIRTYSGTMLKFKNATVNVKDNPIVN  120
```

The complete length ORF91ng nucleotide sequence <SEQ ID 351> is predicted to encode a protein having amino acid sequence <SEQ ID 352>:

```
  1 VKKSSFISAL GIGILSIGMA FASPADAVGQ IRQNATQVLT ILKSGDAASA

51 RPKAEAYAVP YFDFQRMTAL AVGNPWRTAS DAQKQALAKE FQTLLIRTYS

101 GTMLKFKNAT VNVKDNPIVN KGGKEIVVRA EVGIPGQKPV NMDFTTYQSG

151 GKYRTYNVAI EGTSLVTVYR NQFGEIIKAK GIDGLIAELK AKNGGK*
```

Further work revealed the complete nucleotide sequence <SEQ ID 353>:

```
  1 ATGAAAAAAT CCTCCTTCAT CAGCGCATTG GGCATCGGTA TTTTGAGCAT

51 CGGCATGGCA TTTGCCTCCC CGGCCGACGC AGTGGGACAA ATCCGCCAAA

101 ACGCCACACA GGTTTTGACC ATCCTCAAAA GCGGCGACGC GGCTTCTGCA

151 CGCCCAAAAG CCGAAGCCTA TCCGGTTCCC TATTTCGATT TCCAACGTAT

201 GACCGCATTG GCGGTCGGCA ACCCTTGGCG TACCGCGTCC GACGCGCAAA

251 AACAAGCGTT GGCCAAAGAA TTTCAAACCC TGCTGATCCG CACCTATTCC

301 GGCACGATGC TGAAATTCAA AAACGCGACC GTCAACGTCA AGACAATCC

351 CATCGTCAAT AAGGGCGGCA AGGAAATCGT CGTCCGTGCC GAAGTCGGCA

401 TCCCCGGTCA GAAGCCCGTC AATATGGACT TTACCACCTA CCAAAGCGGC

451 GGCAAATACC GTACCTACAA CGTCGCCATC GAAGGCACGA GCCTGGTTAC

501 CGTGTACCGC AACCAATTCG GCGAAATCAT CAAAGCCAAA GGCATCGACG

551 GGCTGATTGC CGAGTTGAAA GCCAAAAACG GCGGCAAATA A
```

This corresponds to the amino acid sequence <SEQ ID 354; ORF91ng-1>:

```
  1 MKKSSFISAL GIGILSIGMA FASPADAVGQ IRQNATQVLT TLKSGDAASA

51 RPKAEAYAVP YFDFQRMTAL AVGNPWRTAS DAQKQALAKE FQTLLIRTYS
```

```
101 GTMLKFKNAT VNVKDNPIVN KGGKEIVVRA EVGIPGQKPV NMDFTTYQSG

151 GKYRTYNVAI EGTSLVTVYR NQFGEIIKAK GIDGLIAELK AKNGGK*
```

ORF91ng-1 and ORF91-1 show 92.3% identity in 196 aa overlap:

```
                       10         20         30         40         50         60
    orf91-1.pep    MKKSSLISALGIGILSIGMAFAAPADAVSQIRQNATQVLSILKNGDANTARQKAEAYAIP
                   ||||:|||||||||||||||||:||||:||||||||||:|||:|||:||||||:
    orf91ng-1      MKKSSFISALGIGILSIGMAFASPADAVGQIRQNATQVLTILKSGDAASARPKAEAYAVP
                       10         20         30         40         50         60

70         80         90        100        110        120
    orf91-1.pep    YFDFQRMTALAVGNPWRTASDAQKQALAKEFQTLLIRTYSGTMLKLKNANVNVKDNPIVN
                   ||||||||||||||||||||||||||||||||||||||||||||||:|:|||||||||
    orf91ng-1      YFDFQRMTALAVGNPWRTASDAQKQALAKEFQTLLIRTYSGTMLKFKNATVNVKDNPIVN
                       70         80         90        100        110        120

130        140        150        160        170        180
    orf91-1.pep    KGGKEIIVRAEVGVPGQKPVNMDFTTYQSGGKYRTYNVAIEGASLVTVYRNQFGEIIKAK
                   ||||||:|||||:|||||||||||||||||||||||||||:|||||||||||||||||
    orf91ng-1      KGGKEIVVRAEVGIPGQKPVNMDFTTYQSGGKYRTYNVAIEGTSLVTVYRNQFGEIIKAK
                      130        140        150        160        170        180

190
    orf91-1.pep    GVDGLIAELKAKNGGKX
                   |:|||||||||||||||
    orf91ng-1      GIDGLIAELKAKNGGKX
                      190
```

In addition, ORF91ng-1 shows homology to a hypothetical *E. coli* protein:

```
sp|P45390|YRBC_ECOLI HYPOTHETICAL 24.0 KD PROTEIN IN MURA-RPON
INTERGENIC REGION PRECURSOR (F211) >gi|606130 (U18997) ORF_f211
[Escherichia coli] >gi|1789583 (AE000399) hypothetical 24.0 kD
protein in murZ-rpoN intergenic region [Escherichia coli]
Length = 211

Score = 70.6 bits (170), Expect = 6e = 12
Identities = 42/137 (30%), Positives = 76/137 (54%), Gaps = 6/137 (4%)

Query:   59 VPYFDFQRMTALAVGNPWRTASDAQKQALAKEFQTLLIRTYSGTMLKFKNATVNVKDNPI 118
            +PY  +    AL +G  +++A+ AQ++A      F+  L +Y  +   T    +   P
Sbjct:   65 LPYVQVKYAGALVLGQYYKSATPAQREAYFAAFREYLKQAYGQALAMYHGQTYQIA--PE 122

Query:  119 VNKGGKEIV-VRAEVGIP-GQKPVNMDFTTYQSG--GKYRTYNVAIEGTSLVTVYRNQFG 174
                G K  IV +R +  P G+  PV +DF  ++     G ++ Y++   EG S++T   +N++G
Sbjct:  123 QPLGDKTIVPIRVTIIDPNGRPPVRLDFQWRKNSQTGNWQAYDMIAEGVSMITTKQNEWG 182

Query:  175 EIIKAKGIDGLIAELKA                                            191
            +++  KGIDGL A+LK+
Sbjct:  183 TLLRTKGIDGLTAQLKS                                            199
```

Based on this analysis, including the presence of a putative leader sequence in the gonococcal protein, it is predicted that the proteins from *N. meningitidis* and *N. gonorrhoeae*, and their epitopes, could be useful antigens for vaccines or diagnostics, or for raising antibodies.

Example 42

The following DNA sequence was identified in *N. meningitidis* <SEQ ID 355>:

```
  1 ATGAAACACA TACTCCCCCT GATTGCCGCA TCCGCACTCT GCATTTCAAC

51 CGCTTCGGCA CATCCTGCCA GCGAACCGTC CACTCAAAAC GAAACCGCTA
```

```
-continued
101 TGATCACGCA TACCCTCATC TCAAAATACA GTTTTGGnnn nnnnnnnnnn 151 nnnnnnnnnn nnGCCATAAA AAGCAAAGGG ATGGACATTT TTGCCGTCAT

201 CGACCATCAG GAAGCCGCAC GCCGAAACGG CTTAACGATG CAGCCGGCAA

251 AAGTCATCGT CTTCGGCACG CCCAAAGCCG GCACGCCGCT GATGGTCAAA

301 GACCCCGCCT TCGCCCTGCA ACTGCCCCTA CGCGTCCTCG TTACCGAAAC

351 GGACGGCAAA GTACGCGCCG CCTATACCGA TACGCGCGCC CTCATCGCCG

401 GCAGCCGCAT CGGTTTCGAC GAAGTGGCAA ACACTTTGGC AAACGCCGAA

451 AAACTGATAC AAAAAACCGT AGGCGAATAA
```

This corresponds to the amino acid sequence <SEQ ID 356; ORF97>:

```
  1 MKHILPLIAA SALCISTASA HPASEPSTQN ETAMITHTLI SKYSFGXXXX

51 XXXXAIKSKG MDIFAVIDHQ EAARRNGLTM QPAKVIVFGT PKAGTPLMVK

101 DPAFALQLPL RVLVTETDGK VRAAYTDTRA LIAGSRIGFD EVANTLANAE

151 KLIQKTVGE*
```

Further work revealed the complete nucleotide sequence <SEQ ID 357>:

```
  1 ATGAAACACA TACTCCCCCT GATTGCCGCA TCCGCACTCT GCATTTCAAC

51 CGCTTCGGCA CATCCTGCCA GCGAACCGTC CACCCAAAAC GAAACCGCTA

101 TGACCACGCA TACCCTCACC TCAAAATACA GTTTTGACGA AACCGTCAGC

151 CGCCTTGAAA CCGCCATAAA AAGCAAAGGG ATGGACATTT TTGCCGTCAT

201 CGACCATCAG GAAGCCGCCC GCCGAAACGG CTTAACGATG CAGCCGGCAA

251 AAGTCATCGT CTTCGGCACG CCCAAAGCCG GCACGCCGCT GATGGTCAAA

301 GACCCCGCCT TCGCCCTGCA ACTGCCCCTA CGCGTCCTCG TTACCGAAAC

351 GGACGGCAAA GTACGCGCCG CCTATACCGA TACGCGCGCC CTCATCGCCG

401 GCAGCCGCAT CGGTTTCGAC GAAGTGGCAA ACACTTTGGC AAACGCCGAA

451 AAACTGATAC AAAAAACCGT AGGCGAATAA
```

This corresponds to the amino acid sequence <SEQ ID 358; ORF97-1>:

```
  1 MKHILPLIAA SALCISTASA HPASEPSTQN ETAMTTHTLT SKYSFDETVS

51 RLETAIKSKG MDIFAVIDHQ EAARRNGLTM QPAKVIVFGT PKAGTPLMVK

101 DPAFALQLPL RVLVTETDGK VRAAYTDTRA LIAGSRIGFD EVANTLANAE

151 KLIQKTVGE*
```

Computer analysis of this amino acid sequence gave the following results:

Homology with a Predicted ORF from *N. meningitidis* (Strain A)

ORF97 shows 88.7% identity over a 159aa overlap with an ORF (ORF97a) from strain A of *N. meningitidis*:

```
                10         20         30         40         50         60
orf97.pep   MKHILPLIAASALCISTASAHPASEPSTQNETAMITHTLISKYSFGXXXXXXXXXAIKSKG
            |||||  |||||||||||||| ||||| ||||||| ||||| ||||||         ||||||
orf97a      MXHILPLXXASALCISTASXHPASEPQTQNETAMTTHTLTSKYSFDETVSRLETAIKSKG
                10         20         30         40         50         60

70         80         90        100        110        120
orf97.pep   MDIFAVIDHQEAARRNGLTMQPAKVIVFGTPKAGTPLMVKDPAFALQLPLRVLVTETDGK
            ||||||||||||||||||||||||||||||||||||||||||||||||||||| ||||||
orf97a      MDIFAVIDHQEAARRNGLTMQPAKVIVFGTPKAGTPLMVKDPAFALQLPLRVXVTETDGK
                70         80         90        100        110        120

130        140        150        160
orf97.pep   VRAAYTDTRALIAGSRIGFDEVANTLANAEKLIQKTVGEX
            ||||||||||||||||||||||||||||||||||| |||
orf97a      VRAAYTDTRALIAGSRIGFDEVANTLANAEKLIQKTIGEX
               130        140        150        160
```

The complete length ORF97a nucleotide sequence <SEQ ID 359> is:

```
  1 ATGANACACA TACTCCCCCT GANTGNCGCA TCCGCACTCT GCATTTCAAC

51 CGCTTCGGNN CATCCTGCCA GCGAACCGCA AACCCAAAAC GAAACCGCTA

101 TGACCACGCA TACCCTCACC TCAAAATACA GTTTTGACGA AACCGTCAGC

151 CGCCTTGAAA CCGCCATAAA AAGCAAAGGG ATGGACATTT TTGCCGTCAT

201 CGACCATCAG GAAGCCGCCC GCCGAAACGG CTTAACGATG CAGCCGGCAA

251 AAGTCATCGT CTTCGGCACG CCCAAAGCCG GTACGCCGCT GATGGTCAAA

301 GACCCCGCCT TCGCCCTGCA ACTGCCCCTG CGCGTCNTCG TTACCGAAAC

351 GGACGGCAAA GTACGCGCCG CCTATACCGA TACGCGCGCC CTCATCGCCG

401 GCAGCCGCAT CGGTTTCGAC CAAGTGGCAA ACACTTTGGC AAACGCCGAA

451 AAACTGATAC AAAAAACCAT AGGCGAATAA
```

This encodes a protein having amino acid sequence <SEQ ID 360>:

```
  1 MXHILPLXXA SALCISTASX HPASEPQTQN ETAMTTHTLT SKYSFDETVS

51 RLETAIKSKG MDIFAVIDHQ EAARRNGLTM QPAKVIVFGT PKAGTPLMVK

101 DPAFALQLPL RVXVTETDGK VRAAYTDTRA LIAGSRIGFD EVANTLANAE

151 KLIQKTIGE*
```

ORF97a and ORF97-1 show 95.6% identity in 159 aa overlap:

```
                10         20         30         40         50         60
orf97a.pep  MXHILPLXXASALCISTASXHPASEPQTQNETAMTTHTLTSKYSFDETVSRLETAIKSKG
             |||||  ||||||||||||| ||||| ||||||| ||||| ||||||||||||||||||||
orf97-1     MKHILPLIAASALCISTASAHPASEPSTQNETAMTTHTLTSKYSFDETVSRLETAIKSKG
                10         20         30         40         50         60

70         80         90        100        110        120
orf97a.pep  MDIFAVIDHQEAARRNGLTMQPAKVIVFGTPKAGTPLMVKDPAFALQLPLRVXVTETDGK
            ||||||||||||||||||||||||||||||||||||||||||||||||||||| ||||||
orf97-1     MDIFAVIDHQEAARRNGLTMQPAKVIVFGTPKAGTPLMVKDPAFALQLPLRVLVTETDGK
                70         80         90        100        110        120

130        140        150        160
orf97a.pep  VRAAYTDTRALIAGSRIGFDEVANTLANAEKLIQKTIGEX
            ||||||||||||||||||||||||||||||||||| |||
orf97-1     VRAAYTDTRALIAGSRIGFDEVANTLANAEKLIQKTVGEX
               130        140        150        160
```

Homology with a Predicted ORF from *N. gonorrhoeae*
ORF97 shows 88.1% identity over a 159aa overlap with a predicted ORF (ORF97.ng) from *N. gonorrhoeae*:

```
orf97.pep    MKHILPLIAASALCISTASAHPASEPSTQNETAMITHTLISKYSFGXXXXXXXXXAIKSKG   60
             |||||| |||| :|||||||||| :| |||||| |||||| :||||||   :    :||||||
orf97ng      MKHILPPIAASAFCISTASAHPAGKPPTQNETAMTTHTLTSKYSFDETVSRLETAIKSKG   60 orf97.pep    MDIFAVIDHQEAARRNGLTMQPAKVIVFGTPKAGTPLMVKDPAFALQLPLRVLVTETDGK  120
             ||||||||||||||||||||||||||||||||||||||||||||||||||||||||||||
orf97ng      MDIFAVIDHQEAARRNGLTMQPAKVIVFGTPKAGTPLMVKDPAFALQLPLRVLVTETDGK  120 orf97.pep    VRAAYTDTRALIAGSRIGFDEVANTLANAEKLIQKTVGE  159
             || :|||||||| :|||:|||||||||||||||||||||
orf97ng      VRTAYTDTRALIVGSRISFDEVANTLANAEKLIQKTVGE  159
```

The complete length ORF97ng nucleotide sequence <SEQ ID 361> is predicted to encode a protein having amino acid sequence <SEQ ID 362>:

```
  1 MKHILPPIAA SAFCISTASA HPAGKPPTQN ETAMTTHTLT SKYSFDETVS
 51 RLETAIKSKG MDIFAVIDHQ EAARRNGLTM QPAKVIVFGT PKAGTPLMVK
101 DPAFALQLPL RVLVTETDGK VRTAYTDTRA LIVGSRISFD EVANTLANAE
151 KLIQKTVGE*
```

Further work revealed the complete nucleotide sequence <SEQ ID 363>:

```
  1 ATGAAACACA TACTCCCcct gatcgccgca TccgcactCT GCATTTCAAC
 51 CGCTTCGGCA CACCCTGCCG GCAAACCGCC CACCCAAAAC GAAACCGCTA
101 TGACCACGCA CACCCTCACC TCGAAATACA GTTTTGACGA AACCGTCAGC
151 CGCCTTGAAA CCGCCATAAA AAGCAAAGGG ATGGACATTT TTGCCGTCAT
201 CGACCATCAG GAAGCGGCAC GCCGAAACGG CCTGACCATG CAGCCGGCAA
251 AAGTCATCGT CTTCGGCACG CCCAAGGCCG GTACGCCgct GATGGTCAAA
301 GACCCCGCCT TCGCCCTGCA ACTGCCCCTG CGCGTCCTCG TTACCGAAAC
351 GGACGGCAAA GTACGCACCG CCTATACCGA TACGCGCGCC CTCATCGTCG
401 GCAGCCGCAT CAGTTTCGAC GAAGTGGCAA ACACTTTGGC AAACGCCGAA
451 AAACTGATAC AAAAAACCGT AGGCGAATAA
```

This corresponds to the amino acid sequence <SEQ ID 364; ORF97ng-1>:

```
  1 MKHILPLIAA SALCISTASA HPAGKPPTQN ETAMTTHTLT SKYSFDETVS
 51 RLETAIKSKG MDIFAVIDHQ EAARRNGLTM QPAKVIVFGT PKAGTPLMVK
101 DPAFALQLPL RVLVTETDGK VRTAYTDTRA LIVGSRISFD EVANTLANAE
151 KLIQKTVGE*
```

ORF97ng-1 and ORF97-1 show 96.2% identity in 159 aa overlap:

```
              10        20        30        40        50        60
orf97-1.pep   MKHILPLIAASALCISTASAHPASEPSTQNETAMTTHTLTSKYSFDETVSRLETAIKSKG
              ||||||||||||||||||||||||:::|||||||||||||||||||||||||||||||||
orf97ng-1     MKHILPLIAASALCISTASAHPAGKPPTQNETAMTTHTLTSKYSFDETVSRLETAIKSKG
              10        20        30        40        50        60

70        80        90        100       110       120
orf97-1.pep   MDIFAVIDHQEAARRNGLTMQPAKVIVFGTPKAGTPLMVKDPAFALQLPLRVLVTETDGK
              ||||||||||||||||||||||||||||||||||||||||||||||||||||||||||||
orf97ng-1     MDIFAVIDHQEAARRNGLTMQPAKVIVFGTPKAGTPLMVKDPAFALQLPLRVLVTETDGK
              70        80        90        100       110       120

130       140       150       160
orf97-1.pep   VRAAYTDTRALIAGSRIGFDEVANTLANAEKLIQKTVGEX
              ||:|||||||||:||||:||||||||||||||||||||||
orf97ng-1     VRTAYTDTRALIVGSRISFDEVANTLANAEKLIQKTVGEX
              130       140       150       160
```

Based on this analysis, including the presence of a putative leader sequence in the gonococcal protein, it was predicted that the proteins from *N. meningitidis* and *N. gonorrhoeae*, and their epitopes, could be useful antigens for vaccines or diagnostics, or for raising antibodies.

Figure 12:
Figure 12:
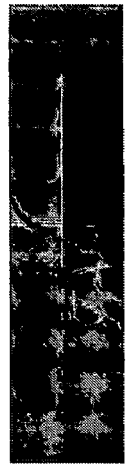
Figure 12:
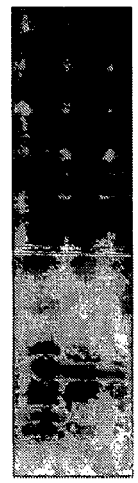
Figure 12D:
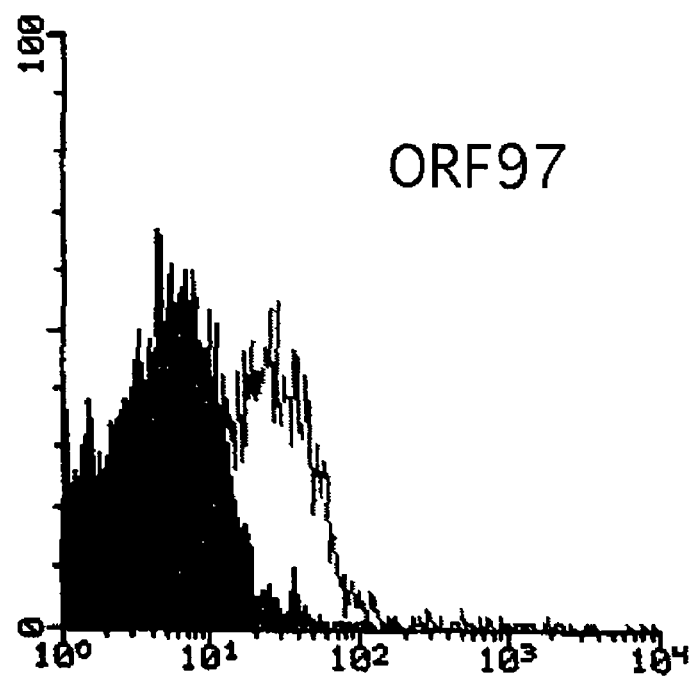
Figure 12E:
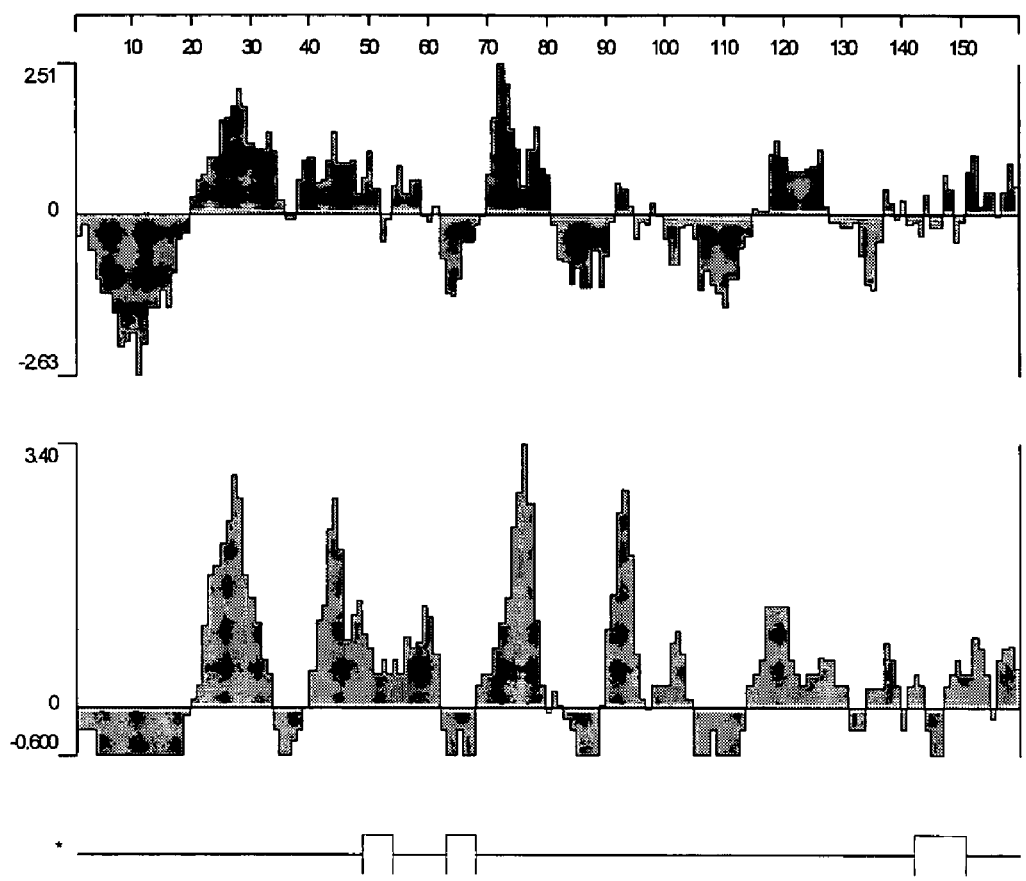

ORF97-1 (15.3 kDa) was cloned in pET and pGex vectors and expressed in *E. coli*, as described above. The products of protein expression and purification were analyzed by SDS-PAGE. FIGS. 12A & 12B show, respectively, the results of affinity purification of the GST-fusion and His-fusion proteins. Purified GST-fusion protein was used to immunise mice, whose sera were used for Western Blot (FIG. 12C), ELISA (positive result), and FACS analysis (FIG. 12D). These experiments confirm that ORF97-1 is a surface-exposed protein, and that it is a useful immunogen. FIG. 12E shows plots of hydrophilicity, antigenic index, and AMPHI regions for ORF97-1.

Example 43

The following DNA, believed to be complete, sequence was identified in *N. meningitidis* <SEQ ID 365>:

```
  1 ATGGCTTTTA TTACGCGCTT ATTCAAAAGC AGTAAATGGC TGATTGTGCC

51 GCTGATGCTC CCCGCCTTTC AGAATGTGGC GGCGGAGGGG ATAGATGTGA

101 GCCGTGCCGA AGCGAGGATA ACCGACGGCG GGCAGCTTTC CATCAGCAGC

151 CGCTTCCAAA CCGAGCTGCC CGACCAGCTC AACAGGCGT TGCGCCGGGg

201 CGTGCCGCTC AACTTTACCT TAAGCTGGCA GCTTTCCGCC CCGATAATCG

251 CTTCTTATCG GTTTAAATTG GGGCAACTGA TTGGCGATGA CGACaATATT

301 GACTACAAAC TGAGTTTCCA TCCGCTGACc AaACGCTACC GCGTTACCgT

351 CGgCGCGTTT TCGACAGACT ACGACACCTT GGATGCGGCA TTGCGCGCGA

401 CCGGCGCGGT TGCCAACTGG AAAGTCCTGA ACAAAGGCGC GCTGTCCGGT

451 GCGGAAGCAG GGGAAACCAA GGCGGAAATC CGCCTGACGC TGTCCACTTC

501 AAAACTGCCC AAGCCTTTTC AAATCAATGC ATTGACTTCT CAAAACTGGC

551 ATTTGGATTC GGGTTGGAAA CCTCTAAACA TCATCGGGAA CAAATAA
```

This corresponds to the amino acid sequence <SEQ ID 366; ORF106>:

```
  1 MAFITRLFKS SKWLIVPLML PAFQNVAAEG IDVSRAEARI TDGGQLSISS

51 RFQTELPDQL QQALRRGVPL NFTLSWQLSA PIIASYRFKL GQLIGDDDNI

101 DYKLSFHPLT KRYRVTVGAF STDYDTLDAA LRATGAVANW KVLNKGALSG

151 AEAGETKAEI RLTLSTSKLP KPFQINALTS QNWHLDSGWK PLNIIGNK*
```

Further work revealed the following DNA sequence <SEQ ID 367>:

```
  1 ATGGCTTTTA TTACGCGCTT ATTCAAAAGC AGTAAATGGC TGATTGTGCC

51 GCTGATGCTC CCCGCCTTTC AGAATGTGGC GGCGGAGGGG ATAGATGTGA

101 GCCGTGCCGA AGCGAGGATA ACCGACGGCG GGCAGCTTTC CATCAGCAGC

151 CGCTTCCAAA CCGAGCTGCC CGACCAGCTC AACAGGCGT TGCGCCGGGG

201 CGTGCCGCTC AACTTTACCT TAAGCTGGCA GCTTTCCGCC CCGATAATCG

251 CTTCTTATCG GTTTAAATTG GGGCAACTGA TTGGCGATGA CGACAATATT

301 GACTACAAAC TGAGTTTCCA TCCGCTGACC AACCGCTACC GCGTTACCGT

351 CGGCGCGTTT TCGACAGACT ACGACACCTT GGATGCGGCA TTGCGCGCGA

401 CCGGCGCGGT TGCCAACTGG AAAGTCCTGA ACAAAGGCGC GCTGTCCGGT

451 GCGGAAGCAG GGGAAACCAA GGCGGAAATC CGCCTGACGC TGTCCACTTC

501 AAAACTGCCC AAGCCTTTTC AAATCAATGC ATTGACTTCT CAAAACTGGC

551 ATTTGGATTC GGGTTGGAAA CCTCTAAACA TCATCGGGAA CAAATAA
```

This corresponds to the amino acid sequence <SEQ ID 368; ORF106-1>:

```
  1 MAFITRLFKS SKWLIVPLML PAFQNVAAEG IDVSRAEARI TDGGQLSISS

51 RFQTELPDQL QQALRRGVPL NFTLSWQLSA PIIASYRFKL GQLIGDDDNI

101 DYKLSFHPLT NRYRVTVGAF STDYDTLDAA LRATGAVANW KVLNKGALSG

151 AEAGETKAEI RLTLSTSKLP KPFQINALTS QNWHLDSGWK PLNIIGNK*
```

Computer analysis of this amino acid sequence gave the following results:

Homology with a Predicted ORF from *N. meningitidis* (Strain A)

ORF106 shows 87.4% identity over a 199aa overlap with an ORF (ORF106a) from strain A of *N. meningitidis*:

```
                     10         20         30         40         50         59
   orf106.pep   MAFITRLFKSSK-WLIVPLMLPAFQNVAAEGIDVSRAEARITDGGQLSISSRFQTELPDQ
                ||||||||||| |  ||   ||  :: ::|||||||||||| |||||| ||||||||||
   orf106a      MAFITRLFKSIKQWLVLLPMLSVLPDAAAEGIDVSRAEARIXDGGQLSXXSRFQTELPDQ
                     10         20         30         40         50         60

60         70         80         90        100        110        119
   orf106.pep   LQQALRRGVPLNFTLSWQLSAPIIASYRFKLGQLIGDDDNIDYKLSFHPLTKRYRVTVGA
                || ||||||| |  | ||||||||||||||||||||||||| |||||||||||:|||||||
   orf106a      LQXAXXRGVXLNXTLXWQLSAPIIASYRFXLGQLIGDDDXIDYKLSFHPLTNRYRVTVGA
                     70         80         90        100        110        120
```

```
                 120        130        140        150        160        170        179
orf106.pep    FSTDYDTLDAALRATGAVANWKVLNKGALSGAEAGETKAEIRLTLSTSKLPKPFQINALT
              ||| ||||||||||||||||||||||||||||||||||||||||||||||||||||||||
orf106a       FSTXYDTLDAALRATGAVANWKVLNKGALSGAEAGETKAEIRLTLSTSKLPKPFQINALT
                  130        140        150        160        170        180

180        190        199
orf106.pep    SQNWHLDSGWKPLNIIGNKX
              ||||||||||||||||||||
orf106a       SQNWHLDSGWKPLNIIGNKX
                  190        200
```

Due to the K→N substitution at residue 111, the homology between ORF106a and ORF106-1 is 87.9% over the same 199 aa overlap.

The complete length ORF106a nucleotide sequence <SEQ ID 369> is:

```
  1 ATGGCTTTTA TTACGCGCTT ATTCAAAAGC ATTAAACAAT GGCTTGTGCT

51 GCTGCCGATG CTTTCCGTTT TGCCGGACGC GGCGGCGGAG GGGATAGATG

101 TGAGCCGCGC CGAAGCGAGG ATAANCGACG GCGGGCAGCT TTCCATNAGN

151 AGCCGCTTCC AAACCGAGCT GCCCGACCAG CTCCAANNNG CGNNGNGCCG

201 GGGCGTGNCG CTCAACTNTA CCTTAAGNTG GCAGCTTTCC GCCCCGATAA

251 TCGCTTCTTA TCGGTTTNAA TTGGGGCAAC TGATTGGCGA TGACGACNAT

301 ATTGACTACA AACTGAGTTT CCATCCGCTG ACCAACCGCT ACCGCGTTAC

351 CGTCGGCGCG TTTTCGACAG ANTACGACAC CTTGGATGCG GCATTGCGCG

401 CGACCGGCGC GGTTGCCAAC TGGAAAGTCC TGAACAAAGG CGCGCTGTCC

451 GGTGCGGAAG CAGGGGAAAC CAAGGCGGAA ATCCGCCTGA CGCTGTCCAC

501 TTCAAAACTG CCCAAGCCTT TCAAATCAA TGCATTGACT TCTCAAAACT

551 GGCATTTGGA TTCGGGTTGG AAACCTCTAA ACATCATCGG GAACAAATAA
```

This encodes a protein having amino acid sequence <SEQ ID 370>:

```
  1 MAFITRLFKS IKQWLVLLPM LSVLPDAAAE GIDVSRAEAR IXDGGQLSXX

51 SRFQTELPDQ LQXAXXRGVX LNXTLXWQLS APIIASYRFX LGQLIGDDDX

101 IDYKLSFHPL TNRYRVTVGA FSTXYDTLDA ALRATGAVAN WKVLNKGALS

151 GAEAGETKAE IRLTLSTSKL PKPFQINALT SQNWHLDSGW KPLNIIGNK*
```

Homology with a Predicted ORF from *N. gonorrhoeae*

ORF106 shows 90.5% identity over a 199aa overlap with a predicted ORF (ORF106.ng) from *N. gonorrhoeae*:

```
orf106.pep    MAFITRLFKSSK-WLIVPLMLPAFQNVAAEGIDVSRAEARITDGGQLSISSRFQTELPDQ   59
              |||||||||||  |  ||::  :|  :: ::||||  ::|||||||||:||||||||||
orf106ng      MAFITRLFKSIKQWLVLLPILSVLPDAAAEGIAATRAEARITDGGRLSISSRFQTELPDQ   60
orf106.pep    LQQALRRGVPLNFTLSWQLSAPIIASYRFKLGQLIGDDDNIDYKLSFHPLTKRYRVTVGA  119
              ||||||||||||||||||||||||||||||||||||||||||||||||||| |||||||
orf106ng      LQQALRRGVPLNFTLSWQLSAPTIASYRFKLGQLIGDDDNIDYKLSFHPLTNRYRVTVGA  120
orf106.pep    FSTDYDTLDAALRATGAVANWKVLNKGALSGAEAGETKAEIRLTLSTSKLPKPFQINALT  179
              ||||||||||||||||||||||||||||||||||||||||||||||||||||||||||||
orf106ng      FSTDYDTLDAALRATGAVANWKVLNKGALSGAEAGETKAEIRLTLSTSKLPKPFQINALT  180
```

```
orf106.pep    SQNWHLDSGWKPLNIIGNK    198
              |||||||||||||||||||
orf106ng      SQNWHLDSGWKPLNIIGNK    199
```

Due to the K→N substitution at residue 111, the homology between ORF106ng and ORF106-1 is 91.0% over the same 199 aa overlap.

The complete length ORF106ng nucleotide sequence <SEQ ID 371> is:

```
  1 ATGGCTTTTA TTACGCGCTT ATTCAAAAGC ATTAAACAAT GGCTTGTGCT
 51 GTTGCCGATA CTCTCCGTTT TGCCGGACGC GGCGGCGGAG GGCATTGCCG
101 CGACCCGCGC CGAAGCGAGG ATAACCGACG GCGGGCGGCT TTCCATCAGC
151 AGCCGCTTCC AAACCGAGCT GCCCGACCAG CTCCAACAGG CGTTGCGCCG
201 GGGCGTACCG CTCAACTTTA CCTTAAGCTG GCAGCTTTCC GCCCCGACAA
251 TCGCTTCTTA TCGGTTTAAA TTGGGGCAAC TGATTGGCGA TGACGACAAT
301 ATTGACTACA AACTAAGTTT CCATCCGCTG ACCAACCGCT ACCGCGTTAC
351 CGTCGGCGCA TTTTCCACCG ATTACGACAC TTTGGATGCG GCATTGCGCG
401 CGACCGGCGC GGTTGCCAAC TGGAAAGTCC TGAACAAAGG CGCGTTGTCC
451 GGTGCGGAAG CAGGGGAAAC CAAGGCGGAA ATCCGCCTGA CGCTGTCCAC
501 TTCAAAACTG CCCAAGCCTT TCCAAATCAA CGCATTGACT TCTCAAAACT
551 GGCATTTGGA TTCGGGTTGG AAACCTCTAA ACATCATCGG GAACAAATAA
```

This encodes a protein having amino acid sequence <SEQ ID 372>:

```
  1 MAFITRLFKS IKQWLVLLPI LSVLPDAAAE GIAATRAEAR ITDGGRLSIS

51 SRFQTELPDQ LQQALRRGVP LNFTLSWQLS APTIASYRFK LGQLIGDDDN

101 IDYKLSFHPL TNRYRVTVGA FSTDYDTLDA ALRATGAVAN WKVLNKGALS

151 GAEAGETKAE IRLTLSTSKL PKPFQINALT SQNWHLDSGW KPLNIIGNK*
```

Based on this analysis, including the presence of a putative leader sequence in the gonococcal protein, it was predicted that the proteins from *N. meningitidis* and *N. gonorrhoeae*, and their epitopes, could be useful antigens for vaccines or diagnostics, or for raising antibodies.

ORF106-1 (18 kDa) was cloned in pET and pGex vectors and expressed in *E. coli*, as described above. The products of protein expression and purification were analyzed by SDS-PAGE. FIG. 13A shows the results of affinity purification of the His-fusion protein, and FIG. 13B shows the results of expression of the GST-fusion in *E. coli*. Purified His-fusion protein was used to immunise mice, whose sera were used for FACS analysis (FIG. 13C) These experiments confirm that ORF106-1 is a surface-exposed protein, and that it is a useful immunogen.

Example 44

The following DNA sequence, believed to be complete, was identified in *N. meningitidis* <SEQ ID 373>:

```
   1 ATGGACACAA AAGAAATCCT CGG.TACGCG GcAGGcTCGA TCGGCAGCGC
  51 GGTTTTAGCC GTCATCATCc TGCCGCTGCT GTCGTGGTAT TTCCCCGCCG
 101 ACGACATCGG GCGCATCGTG CTGATGCAGA CGGCGGCGGG GCTgACGGTG
 151 TCGGTGTTGT GCCTCGGGCT CCATCAGGCA TACGTCCGCG AATACTATGC
 201 CACCGCCGAC AAAGACAcCT TGTTCAAAAC CCTGTTCCTG CCGCCGCTGC
 251 TGTCTGCCGC CGCGATAGCC GCCCTGCTGC TTTCCCGCCC GTCCCTGCCG
 301 TCTGAAATCC TGTTTTCACT CGACGATGCC gCCGCCGGCa TCGGGCTGGT
 351 GCTGTTTGAA CtGAGCTTCC TGCCCATCCG cTTTCTCTTA CTGGTTTTGC
 401 GTATGGAAGG ACGCGCCcTT GCCTTTTCGT CCGCGCAACT CGTGCcCAAG
 451 CTCGCCATCC TGCTGCTG.T GCCGCTGACG GTCGGGCTGC TGCACTTTCC
 501 AGCGAACACC GCCGTCCTGA CCGCCGTTTA CGCGCTGGCA AACCTTGCCG
 551 CCGCCGCCTT TTTGCTGTTT CAAAACCGAT GCCGTCTGAA GGCCGTCCGG
 601 CACGCACCGT TTTCGCCCGC CGTCCTGCAC CGGGGG.TGC GCTACGGCAT
 651 ACCGATCGCA CTGAGCAGCA TCGCCTATTG GGGGCTGGCA TCCGCCGACC
 701 GTTTGTTCCT GAAAAAATAT GCCGGCCTGG AACAGCTCGG CGTTTATTCG
 751 ATGGGTATTT CGTTCGGCGG GGCGGCATTA TTGTTCCAAA GCATCTTTTC
 801 AACGGTCTGG ACACCGTATA TTTTCCGCGC AATCGAAGAA AACGCCCCGC
 851 CCGCTCGCCT CTCGGCAACG GCAGAATCCG CCGCCGCCCT GCTTGCCTCC
 901 GCCCTCTGC. TGACCGGCAT TTTCTCGCCC CTTGCCTCCC TCCTGCTGCC
 951 GGAAAACTAC GCCGCCGTCC GGTTTATCGT CGTATCGTGT ATG.TGCCGC
1001 CGCTGTTTTG CACGCTGGCG GAAATCAGCG GCATCGGTTT GAACGTCGTT
1051 CGCAAAACGC GCCCGATCGC GCTCGCCACC TTGGGCGCGC TGGCGGCAAA
1101 CCTGCTGCTG CTGGGGCTTG ACCGTGCCGT ACCGGCGAGG CCGCC.GGCG
1151 CGGCGGTTGC CTGTGCCGCC TCATTCTGGC TGTTTTTTGC CTTCAAGACC
1201 GAAAGCTCyT GCCGCCTGTG GCAGCCGCTC AAACGCCTGC CGCTTTATCT
1251 GCACACATTG TTCTGCCTGA CCTCCTCGGC GGCCTACACC TGCTTCGGCA
1301 CGCCGGCAAA CTATCCCCTG TTTGCCGGCG TATGGGCGGC ATATCTGGCA
1351 GGCTGCATCC TGCGCCACCG GAAAGATTTG CACAAACTGT TCATTATTT
1401 GAAAAAACAA GGTTTCCCAT TATGA
```

This corresponds to the amino acid sequence <SEQ ID 374; ORF10>:

```
  1 MDTKEILXYA AGSIGSAVLA VIILPLLSWY FPADDIGRIV LMQTAAGLTV
 51 SVLCLGLDQA YVREYYATAD KDTLFKTLFL PPLLSAAAIA ALLLSRPSLP
101 SEILFSLDDA AAGIGLVLFE LSFLPIRFLL LVLRMEGRAL AFSSAQLVPK
151 LAILLLXPLT VGLLHFPANT AVLTAVYALA NLAAAFLLF QNRCRLKAVR
201 HAPFSPAVLH RGXRYGIPIA LSSIAYWGLA SADRLFLKKY AGLEQLGVYS
```

-continued

```
251 MGISFGGAAL LFQSIFSTVW TPYIFRAIEE NAPPARLSAT AESAAALLAS

301 ALCXTGIFSP LASLLLPENY AAVRFIVVSC MXPPLFCTLA EISGIGLNVV

351 RKTRPIALAT LGALAANLLL LGLDRAVPAR PXGAAVACAA SFWLFFAFKT

401 ESSCRLWQPL KRLPLYLHTL FCLTSSAAYT CFGTPANYPL FAGVWAAYLA

451 GCILRHRKDL HKLFHYLKKQ GFPL*
```

Further sequence analysis revealed the complete DNA sequence <SEQ ID 375> to be:

```
   1 ATGGACACAA AAGAAATCCT CGGCTACGCG GCAGGCTCGA TCGGCAGCGC

51 GGTTTTAGCC GTCATCATCC TGCCGCTGCT GTCGTGGTAT TTCCCCGCCG

101 ACGACATCGG GCGCATCGTG CTGATGCAGA CGGCGGCGGG GCTGACGGTG

151 TCGGTGTTGT GCCTCGGGCT GGATCAGGCA TACGTCCGCG AATACTATGC

201 CACCGCCGAC AAAGACACCT TGTTCAAAAC CCTGTTCCTG CCGCCGCTGC

251 TGTCTGCCGC CGCGATAGCC GCCCTGCTGC TTTCCCGCCC GTCCCTGCCG

301 TCTGAAATCC TGTTTTCACT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG ACGCGCCCTT GCCTTTTCGT CCGCGCAACT CGTGCCCAAG

451 CTCGCCATCC TGCTGCTGCT GCCGCTGACG GTCGGGCTGC TGCACTTTCC

501 AGCGAACACC GCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CACGCACCGT TTTCGCCCGC CGTCCTGCAC CGGGGGCTGC GCTACGGCAT

651 ACCGATCGCA CTGAGCAGCA TCGCCTATTG GGGGCTGGCA TCCGCCGACC

701 GTTTGTTCCT GAAAAAATAT GCCGGCCTGG AACAGCTCGG CGTTTATTCG

751 ATGGGTATTT CGTTCGGCGG GGCGGCATTA TTGTTCCAAA GCATCTTTTC

801 AACGGTCTGG ACACCGTATA TTTTCCGCGC AATCGAAGAA AACGCCCCGC

851 CCGCCCGCCT CTCGGCAACG GCAGAATCCG CCGCCGCCCT GCTTGCCTCC

901 GCCCTCTGCC TGACCGGCAT TTTCTCGCCC CTTGCCTCCC TCCTGCTGCC

951 GGAAAACTAC GCCGCCGTCC GGTTTATCGT CGTATCGTGT ATGCTGCCGC

1001 CGCTGTTTTG CACGCTGGCG GAAATCAGCG GCATCGGTTT GAACGTCGTC

1051 CGCAAAACGC GCCCGATCGC GCTCGCCACC TTGGGCGCGC TGGCGGCAAA

1101 CCTGCTGCTG CTGGGGCTTG CCGTGCCGTC CGGCGGCGCG CGCGGCGCGG

1151 CGGTTGCCTG TGCCGCCTCA TTCTGGCTGT TTTTTGCCTT CAAGACCGAA

1201 AGCTCCTGCC GCCTGTGGCA GCCGCTCAAA CGCCTGCCGC TTTATCTGCA

1251 CACATTGTTC TGCCTGACCT CCTCGGCGGC CTACACCTGC TTCGGCACGC

1301 CGGCAAACTA TCCCCTGTTT GCCGGCGTAT GGGCGGCATA TCTGGCAGGC

1351 TGCATCCTGC GCCACCGGAA AGATTTGCAC AAACTGTTTC ATTATTTGAA

1401 AAAACAAGGT TTCCCATTAT GA
```

This corresponds to the amino acid sequence <SEQ ID 376; ORF10-1>:

```
  1 MDTKEILGYA AGSIGSAVLA VIILPLLSWY FPADDIGRIV LMQTAAGLTV

51 SVLCLGLDQA YVREYYATAD KDTLFKTLFL PPLLSAAAIA ALLLSRPSLP

101 SEILFSLDDA AAGIGLVLFE LSFLPIRFLL LVLRMEGRAL AFSSAQLVPK

151 LAILLLLPLT VGLLHFPANT AVLTAVYALA NLAAAAFLLF QNRCRLKAVR

201 HAPFSPAVLH RGLRYGIPIA LSSIAYWGLA SADRLFLKKY AGLEQLGVYS

251 MGISFGGAAL LFQSIFSTVW TPYIFRAIEE NAPPARLSAT AESAAALLAS

301 ALCLTGIFSP LASLLLPENY AAVRFIVVSC MLPPLFCTLA EISGIGLNVV

351 RKTRPIALAT LGALAANLLL LGLAVPSGGA RGAAVACAAS FWLFFAFKTE

401 SSCRLWQPLK RLPLYHTLF CLTSSAAYTC FGTPANYPLF AGVWAAYLAG

451 CILRHRKDLH KLFHYLKKQG FPL*
```

Computer analysis of this amino acid sequence gave the following results:

Prediction

ORF10-1 is predicted to be the precursor of an integral membrane protein, since it comprises several (12-13) potential transmembrane segments, and a probable cleavable signal peptide Homology with EpsM from *Streptococcus thermophilus* (Accession Number U40830).

ORF10 shows homology with the epsM gene of *S. thermophilus*, which encodes a protein of a size similar to ORF10 and is involved in expolysaccharide synthesis. Other homologies are with prokaryotic membrane proteins:

```
Identities = (25%)

Query:  213 LRYGIPLALSSLAYWGLASADRLFLKKYAGLEQLGVYSMGISFGGAALLLQSIFSTVW    270
            L Y +PL   SS+ +W L ++ R F+  + G     G+ ++       +IF+  W
Sbjct:  210 LYYALPLIPSSILWWLLNASSRYFVLFFLGAGANGLLAVATKIPSIISIFNTIFTQAW   267

Identities = 15/57 (26%), Positives = 31/57 (54%)

Query:    7 LGYAAGSIGSAVLAVIILPLLSWYFPADDIGRIVLMQTAAGLTVSVLCLGLDQAYVR     63
            L +  G++GS +L   +++PL ++     + G   L QT A L + ++ + + A +R
Sbjct:   12 LVFTIGNLGSKLLVFLLVPLYTYAMTPQEYGMADLYQTTANLLLPLITMNVFDATLR    68

Identities = 16/96 (16%), Positives = 36/96 (37%)

Query:  307 IFSPLASLLLPENYAAVRFTVVSCMLPPLFYTLTEISGIGLNVVRKTRPIXXXXXXXXXX   366
             +   P+  ++ +YA+     V     ML  LF + ++  G       ++T+ +
Sbjct:  305 VLKPIVEKVVSSDYASSWQYVPFFMLSMLFSSFSDFFGTNYIAAKQTKGVFMTSIYGTIV   364
```

Homology with a Predicted ORF from *N. meningitidis* (Strain A)

ORF10 shows 95.4% identity over a 475aa overlap with an ORF (ORF10a) from strain A of *N. meningitidis*:

```
                      10         20         30         40         50         60
orf10.pep   MDTKEILXYAAGSIGSAVLAVIILPLLSWYFPADDIGRIVLMQTAAGLTVSVLCLGLDQA
            |||||||:||||||||||||||||||||||||||||||||||||||||||||||||||||
orf10a      MDTKEILGYAAGSIGSAVLAVIILPLLSWYFPADDIGRIVLMQTAAGLTVSVLCLGLDQA
                      10         20         30         40         50         60

70         80         90        100        110        120
orf10.pep   YVREYYATADKDTLFKTLFLPPLLSAAAIAALLLSRPSLPSEILFSLDDAAAGIGLVLFE
            |||||||:||||||||||||||||||||||||||||||||||||||||||||||||||||
orf10a      YVREYYAADKDTLFKTLFLPPLLSAAAIAALLLSRPSLPSEILFSLDDAAAGIGLVLFE
                      70         80         90        100        110        120

130        140        150        160        170        180
orf10.pep   LSFLPIRFLLLVLRMEGRALAFSSAQLVPKLAILLLXPLTVGLLHFPANTAVLTAVYALA
            ||||||||||||||||||||||||||||:|||||||:|||||||||||||||||||||||
orf10a      LSFLPIRFLLLVLRMEGRALAFSSAQLVSKLAILLLLPLTVGLLHFPANTAVLTAVYALA
                     130        140        150        160        170        180
```

```
                190       200       210       220       230       240
orf10.pep   NLAAAAFLLFQNRCRLKAVRHAPFSPAVLHRGXRYGIPIALSSIAYWGLASADRLFLKKY
            ||||||||||||||||||||||:||||||||||||||||||||||||||||||||||||
orf10a      NLAAAAFLLFQNRCRLKAVRRAPFSSAVLHRGLRYGIPIALSSIAYWGLASADRLFLKKY
                190       200       210       220       230       240

250       260       270       280       290       300
orf10.pep   AGLEQLGVYSMGISFGGAALLFQSIFSTVWTPYIFRAIEENAPPARLSATAESAAALLAS
            |||||||||||||||||||||||||||||||||||||||:||||||||||||||||||||
orf10a      AGLEQLGVYSMGISFGGAALLFQSIFSTVWTPYIFRAIEANAPPARLSATAESAAALLAS
                250       260       270       280       290       300

310       320       330       340       350       360
orf10.pep   ALCXTGIFSPLASLLLPENYAAVRFIVVSCMXPPLFCTLAEISGIGLNVVRKTRPIALAT
            |||:||||||||||||||||||||||||||||:|||||||:|||||||||||||||||||
orf10a      ALCLTGIFSPLASLLLPENYAAVRFIVVSCMLPPLFCTLVEISGIGLNVVRKTRPIALAT
                310       320       330       340       350       360

370       380       390       400       410      419
orf10.pep   LGALAANLLLLGLDRAVPAR-PXGAAVACAASFWLFFAFKTESSCRLWQPLKRLPLYLHT
            ||||||||||||||:|||  :||||||||||||||||:||||||||||||||||||:||
orf10a      LGALAANLLLLGL--AVPSGGARGAAVACAASFWLFFVFKTESSCRLWQPLKRLPLYMHT
                370       380       390       400       410

420       430       440       450       460       470
orf10.pep   LFCLTSSAAYTCFGTPANYPLFAGVWAAYLAGCILRHRKDLHKLFHYLKKQGFPLX
            ||||:|||||||||||||||||||||:|||||||||||||||||||||||||||||
orf10a      LFCLASSAAYTCFGTPANYPLFAGVWAVYLAGCILRHRKDLHKLFHYLKKQGFPLX
            420       430       440       450       460       470
```

The complete length ORFL0a nucleotide sequence <SEQ ID 377> is:

```
   1 ATGGACACAA AAGAAATCCT CGGCTACGCG GCAGGCTCGA TCGGCAGCGC

51 GGTTTTAGCC GTCATCATCC TGCCGCTGCT GTCGTGGTAT TTCCCTGCCG

101 ACGACATCGG ACGCATCGTC CTGATGCAGA CGGCGGCGGG GCTGACGGTG

151 TCGGTGTTGT GCCTCGGGCT GGATCAGGCA TACGTCCGCG AATACTATGC

201 CGCCGCCGAC AAAGACACTT TGTTCAAAAC CCTGTTCCTG CCGCCGCTGC

251 TGTCTGCCGC CGCGATAGCC GCCCTGCTGC TTTCCCGCCC ATCCCTGCCG

301 TCTGAAATCC TGTTTTCGCT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG ACGCGCCCTT GCCTTTTCGT CCGCGCAACT CGTGTCCAAG

451 CTCGCCATCC TGCTGCTGCT GCCGCTGACG GTCGGGCTGC TGCACTTTCC

501 GGCGAACACC GCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CGCGCACCGT TTTCATCCGC CGTCCTGCAT CGCGGCCTGC GCTACGGCAT

651 ACCGATCGCA CTAAGCAGCA TCGCCTATTG GGGGCTGGCA TCCGCCGACC

701 GTTTGTTCCT GAAAAAATAT GCCGGCCTAG AACAGCTCGG CGTTTATTCG

751 ATGGGTATTT CGTTCGGCGG AGCGGCATTA TTGTTCCAAA GCATCTTTTC

801 AACGGTCTGG ACACCGTATA TTTTCCGCGC AATCGAAGCA AACGCCCCGC

851 CCGCCCGCCT CTCGGCAACG GCAGAATCCG CCGCCGCCCT GCTTGCCTCC

901 GCCCTCTGCC TGACCGGCAT TTTCTCGCCC CTCGCCTCCC TCCTGCTGCC

951 GGAAAACTAC GCCGCCGTCC GGTTTATCGT CGTATCGTGT ATGCTGCCTC

1001 CGCTGTTTTG CACGCTGGTA GAAATCAGCG GCATCGGTTT GAACGTCGTC

1051 CGAAAAACAC CCCGATCGC GCTCGCCACC TTGGGCGCGC TGGCGGCAAA

1101 CCTGCTGCTG CTGGGGCTTG CCGTACCGTC CGGCGGCGCG CGCGGCGCGG

1151 CGGTTGCCTG TGCCGCCTCA TTTTGGCTGT TTTTTGTTTT CAAGACCGAA
```

-continued

```
1201 AGCTCCTGCC GCCTGTGGCA GCCGCTCAAA CGCCTGCCGC TTTATATGCA

1251 CACATTGTTC TGCCTGGCCT CCTCGGCGGC CTACACCTGC TTCGGCACTC

1301 CGGCAAACTA CCCCCTGTTT GCCGGCGTAT GGGCGGTATA TCTGGCAGGC

1351 TGCATCCTGC GCCACCGGAA AGATTTGCAC AAACTGTTTC ATTATTTGAA

1401 AAAACAAGGT TTCCCATTAT GA
```

This encodes a protein having amino acid sequence <SEQ ID 378>:

```
  1 MDTKEILGYA AGSIGSAVLA VIILPLLSWY FPADDIGRIV LMQTAAGLTV

51 SVLCLGLDQA YVREYYAAAD KDTLFKTLFL PPLLSAAAIA ALLLSRPSLP

101 SEILFSLDDA AAGIGLVLFE LSFLPIRFLL LVLRMEGRAL AFSSAQLVSK

151 LAILLLLPLT VGLLHFPANT AVLTAVYALA NLAAAAFLLF QNRCRLKAVR

201 RAPFSSAVLH RGLRYGIPIA LSSIAYWGLA SADRLFLKKY AGLEQLGVYS

251 MGISFGGAAL LFQSIFSTVW TPYIFRAIEA NAPPARLSAT AESAAALLAS

301 ALCLTGIFSP LASLLLPENY AAVRFIVVSC MLPPLFCTLV EISGIGLNVV

351 RKTRPIALAT LGALAANLLL LGLAVPSGGA RGAAVACAAS FWLFFVFKTE

401 SSCRLWQPLK RLPLYMHTLF CLASSAAYTC FGTPANYPLF AGVWAVYLAG

451 CILRHRKDLH KLFHYLKKQG FPL*
```

ORF10a and ORF10-1 show 95.4% identity in 475 aa overlap:

```
                     10         20         30         40         50         60
   orf10-1.pep  MDTKEILXYAAGSIGSAVLAVIILPLLSWYFPADDIGRIVLMQTAAGLTVSVLCLGLDQA
                ||||||  ||||||||||||||||||||||||||||||||||||||||||||||||||||
        orf10a  MDTKEILGYAAGSIGSAVLAVIILPLLSWYFPADDIGRIVLMQTAAGLTVSVLCLGLDQA
                     10         20         30         40         50         60

70         80         90        100        110        120
   orf10-1.pep  YVREYYATADKDTLFKTLFLPPLLSAAAIAALLLSRPSLPSEILFSLDDAAAGIGLVLFE
                ||||||| :|||||||||||||||||||||||||||||||||||||||||||||||||||
        orf10a  YVREYYAAADKDTLFKTLFLPPLLSAAAIAALLLSRPSLPSEILFSLDDAAAGIGLVLFE
                     70         80         90        100        110        120

130        140        150        160        170        180
   orf10-1.pep  LSFLPIRFLLLVLRMEGRALAFSSAQLVPKLAILLLXPLTVGLLHFPANTAVLTAVYALA
                ||||||||||||||||||||||||||||| |||||| |||||||||||||||||||||||
        orf10a  LSFLPIRFLLLVLRMEGRALAFSSAQLVSKLAILLLLPLTVGLLHFPANTAVLTAVYALA
                    130        140        150        160        170        180

190        200        210        220        230        240
   orf10-1.pep  NLAAAAFLLFQNRCRLKAVRHAPFSPAVLHRGXRYGIPIALSSIAYWGLASADRLFLKKY
                |||||||||||||||||||| ||||| ||||| |||||||||||||||||||||||||||
        orf10a  NLAAAAFLLFQNRCRLKAVRRAPFSSAVLHRGLRYGIPIALSSIAYWGLASADRLFLKKY
                    190        200        210        220        230        240

250        260        270        280        290        300
   orf10-1.pep  AGLEQLGVYSMGISFGGAALLFQSIFSTVWTPYIFRAIEENAPPARLSATAESAAALLAS
                ||||||||||||||||||||||||||||||||||||||||| ||||||||||||||||||
        orf10a  AGLEQLGVYSMGISFGGAALLFQSIFSTVWTPYIFRAIEANAPPARLSATAESAAALLAS
                    250        260        270        280        290        300

310        320        330        340        350        360
   orf10-1.pep  ALCXTGIFSPLASLLLPENYAAVRFIVVSCMXPPLFCTLAEISGIGLNVVRKTRPIALAT
                ||| ||||||||||||||||||||||||||| |||||||| :||||||||||||||||||
        orf10a  ALCLTGIFSPLASLLLPENYAAVRFIVVSCMLPPLFCTLVEISGIGLNVVRKTRPIALAT
                    310        320        330        340        350        360

370        380        390        400        410        419
   orf10-1.pep  LGALAANLLLLGLDRAVPAR-PXGAAVACAASFWLFFAFKTESSCRLWQPLKRLPLYHT
                ||||||||||||  :|||||  |||||||||||||| :||||||||||||||||||: ||
        orf10a  LGALAANLLLLGL--AVPSGGARGAAVACAASFWLFFVFKTESSCRLWQPLKRLPLYMHT
                    370        380        390        400        410
```

```
                420       430       440       450       460       470
orf10-1.pep    LFCLTSSAAYTCFGTPANYPLFAGVWAAYLAGCILRHRKDLHKLFHYLKKQGFPLX
               ||||:|||||||||||||||||||||||:|||||||||||||||||||||||||||
orf10a         LFCLASSAAYTCFGTPANYPLFAGVWAVYLAGCILRHRKDLHKLFHYLKKQGFPLX
                420       430       440       450       460       470
```

Homology with a Predicted ORF from *N. gonorrhoeae*

ORF10 shows 94.1% identity over a 475aa overlap with a predicted ORF (ORF10.ng) from *N. gonorrhoeae*:

```
orf10ng.pep    MDTKEILGYAAGSIGSAVLAVIILPLLSWYFPADDIGRIVLMQTAAGLTVSVLCLGLDQA    60
               |||||||| |||||||||||||||||||||||||||||||||||||||||||||||||||
orf10nm        MDTKEILXYAAGSIGSAVLAVIILPLLSWYFPADDIGRIVLMQTAAGLTVSVLCLGLDQA    60
orf10ng.pep    YVREYYAAADKDTLFKTLFLPPLLFSAAIAALLLSRPSLPSEILFSLDDAAAGIGLVLFE   120
               |||||||:|||||||||||||||||:||||||||||||||||||||||||||||||||||
orf10nm        YVREYYATADKDTLFKTLFLPPLLSAAAIAALLLSRPSLPSEILFSLDDAAAGIGLVLFE   120
orf10ng.pep    LSFLPIRFLLLVLRMEGRALAFSSAQLVPKLAILLLLPLTVGLLHPPANTSVLTAVYALA   180
               |||||||||||||||||||||||||||||||||||| |||||||||||||:|||||||||
orf10nm        LSFLPIRFLLLVLRMEGRALAFSSAQLVPKLAILLLXPLTVGLLHPPANTAVLTAVYALA   180
orf10ng.pep    NLAAAAFLLFQNRCRLKAVRHAPFSPAVLHRGLRYGIPLALSSLAYWGLASADRLFLKKY   240
               ||||||||||||||||||||:|||||||||||| ||||:|||||:|||||||||||||||
orf10nm        NLAAAAFLLFQNRCRLKAVRRAPFSPAVLHRGXRYGIPIALSSIAYWGLASADRLFLKKY   240
orf10ng.pep    AGLEQLGVYSMGISFGGAALLLQSIFSTVWTPYIFRAIEENATPARLSATAESAAALLAS   300
               |||||||||||||||||||||:||||||||||||||||||||:|||||||||||||||||
orf10nm        AGLEQLGVYSMGISFGGAALLFQSIFSTVWTPYIFRAIEENAPPARLSATAESAAALLAS   300
orf10ng.pep    ALCLTGIFSPLASLLLPENYAAVRFTVVSCMLPPLFYTLTEISGIGLNVVRKTRPIALAT   360
               |||:|||||||||||||||||||||||:||||||||| ||| ||||||||||||||||||
orf10nm        ALCXTGIFSPLASLLLPENYAAVRFIVVSCMXPPLFCTLAEISGIGLNVVRKTRPIALAT   360
                  370       380       390       400       410
orf10ng.pep    LGALAANLLLLGL--AVPSGGTRGAAVACAASFWLFFVFKTESSCRLWQPLKRLPLYMHT
               ||||||||||||| :|||| |:||||||||||||||:|||||||||||||||||||:||
orf10nm        LGALAANLLLLGLDRAVPAR-PXGAAVACAASFWLFFAPKTESSCRLWQPLKRLPLYLHT
                  370       380       390       400       410
                420       430       440       450       460       470
orf10ng.pep    LFCLASSAAYTCFGTPANYPLFAGVWAAYLAGCILRHRKNLHKLFHYLKKQGFPLX
               ||||:|||||||||||||||||||||||||||||||||| ||||||||||||||||
orf10nm        LFCLTSSAAYTCFGTPANYPLFAGVWAAYLAGCILRHRKDLHKLFHYLKKQGFPLX
                420       430       440       450       460       470
```

The complete length ORF10ng nucleotide sequence <SEQ ID 379> is:

```
  1 ATGGACACAA AAGAAATCCT CGGCTACGCG GCAGGCTCGA TCGGCAGCGC

51 GGTTTTAGCC GTCATCATCC TGCCGCTGCT GTCGTGGTAT TTCcccgCCG

101 ACGACATCGG GCGCATCGTG CTGATGCAGA CGGCGGCGGG ACTGACGGTG

151 TCGGTATTGT GCCTCGGGCT GGATCAGGCA TACGTCCGCG AATACTATGC

201 CGCCGCCGAC AAAGACACTT TGTTCAAAAC CCTGTTCCTG CCGCCGCTGC

251 TGTTTTCCGC CGCGATAGCC GCCCTGCTGC TTTCCCGCCC GTCCCTGCCG

301 TCTGAAATCC TGTTTTCGCT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG GCGCGCCCTT GCCTTTTCGT CCGCGCAACT CGTGCCCAAA

451 CTCGCCATTC TGCTGCTGTT GCCGCTGACG GTCGGGCTGC TGCACTTTCC

501 GGCGAACACC TCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CGCGCGCCGT TTTCGCCCGC CGTCCTGCAC CGGGGGCTGC GCTACGGCAT

651 ACCGCTCGCA CTGAGCAGCC TTGCCTATTG GGGGCTGGCA TCCGCCGACC

701 GTTTGTTCCT GAAAAAATAT GCGGGCCTGG AACAGCTCGG CGTTTATTCG
```

```
 751 ATGGGTATTT CGTTCGGCGG GGCGGCATTA TTGCTCCAAA GCATCTTTTC
 801 AACGGTCTGG ACACCGTATA TTTTCCGTGC AATCGAAGAA AACGCCACGC
 851 CCGCCCGCCT CTCGGCAACG GCAGAATCCG CCGCCGCCCT GCTTGCCTCC
 901 GCCCTCTGCC TGACCGGAAT TTTCTCGCCC CTCGCCTCCC TCCTGCTGCC
 951 GGAAAACTAC GCCGCCGTCC GGTTTACCGT CGTATCGTGT ATGCTGccgc
1001 cgctGTTTTA CACGCTGACC GAAATCAGCG GCATCGGTTT GAACGTCGTC
1051 CGCAAACGC GTCCGATCGC GCTTGCCACC TTGGGCGCGC TGGCGGCAAA
1101 CCTGCTGCTG CTGGGGCTTG CCGTACCGTC CGGCGGCACG CGCGGCGCGG
1151 CGGTTGCCTG TGCCGCCTCA TTCTGGTTGT TTTTTGTTTT CAAGACAGAA
1201 AGCTCCTGCC GCCGTGTGGCA GCCGCTCAAA CGCCTGCCGC TTTATATGCA
1251 CACATTGTTC TGCCTgGCCT CCTCGGCGGC CTACACCTGC TTCGGCACAC
1301 CGGCAAACTA CCCcctgttt gccggcgtAT GGGCGGCATA TCTGGCAGGC
1351 TGCATCCTGC GCCACCGGAA AAATTTGCAC AAACTGTTTC ATTATTTGAA
1401 AAAACAAGGT TTCCCATTAT GA
```

This encodes a protein having amino acid sequence <SEQ ID 380>:

```
  1 MDTKEILGYA AGSIGSAVLA VIILPLLSWY FPADDIGRIV LMQTAAGLTV
 51 SVLCLGLDQA YVREYYAAAD KDTLFKTLFL PPLLFSAAIA ALLLSRPSLP
101 SEILFSLDDA AAGIGLVLFE LSFLPIRFLL LVLRMEGRAL AFSSAQLVPK
151 LAILLLLPLT VGLLHFPANT SVLTAVYALA NLAAAAFLLF QNRCRLKAVR
201 RAPFSPAVLH RGLRYGIPLA LSSLAYWGLA SADRLFLKKY AGLEQLGVYS
251 MGISFGGAAL LLQSIFSTVW TPYIFRAIEE NATPARLSAT AESAAALLAS
301 ALCLTGIFSP LASLLLPENY AAVRFTVVSC MLPPLFYTLT EISGIGLNVV
351 RKTRPIALAT LGALAANLLL LGLAVPSGGT RGAAVACAAS FWLFFVFKTE
401 SSCRLWQPLK RLPLYMHTLF CLASSAAYTC FGTPANYPLF AGVWAAYLAG
451 CILRHRKNLH KLFHYLKKQG FPL*
```

ORF10ng and ORF10-1 show 96.4% identity in 473 aa overlap:

```
                   10         20         30         40         50         60
    orf10-1.pep    MDTKEILGYAAGSIGSAVLAVIIILPLLSWYFPADDIGRIVLMQTAAGLTVSVLCLGLDQA
                   ||||||||||||||||||||||||||||||||||||||||||||||||||||||||||||
    orf10ng-1      MDTKEILGYAAGSIGSAVLAVIIILPLLSWYFPADDIGRIVLMQTAAGLTVSVLCLGLDQA
                   10         20         30         40         50         60

70         80         90        100        110        120
    orf10-1.pep    YVREYYATADKDTLFKTLFLPPLLSAAAIAALLLSRPSLPSEILFSLDDAAAGIGLVLFE
                   ||||||| :||||||||||||||||:|||||||||||||||||||||||||||||||||
    orf10ng-1      YVREYYAAADKDTLFKTLFLPPLLFSAAIAALLLSRPSLPSEILFSLDDAAAGIGLVLFE
                   70         80         90        100        110        120

130        140        150        160        170        180
    orf10-1.pep    LSFLPIRFLLLVLRMEGRALAFSSAQLVPKLAILLLLPLTVGLLHFPANTAVLTAVYALA
                   ||||||||||||||||||||||||||||||||||||||||||||||||||:|||||||||
    orf10ng-1      LSFLPIRFLLLVLRMEGRALAFSSAQLVPKLAILLLLPLTVGLLHFPANTSVLTAVYALA
                   130        140        150        160        170        180
```

```
                    -continued
                190       200       210       220       230       240
orf10-1.pep     NLAAAAFLLFQNRCRLKAVRHAPFSPAVLHRGLRYGIPIALSSIAYWGLASADRLFLKKY
                ||||||||||||||||||||||:|||||||||||||||:|||:|||||||||||||||||
orf10ng-1       NLAAAAFLLFQNRCRLKAVRRAPFSPAVLHRGLRYGIPLALSSLAYWGLASADRLFLKKY
                190       200       210       220       230       240

250       260       270       280       290       300
orf10-1.pep     AGLEQLGVYSMGISFGGAALLFQSIFSTVWTPYIFRAIEENAPPARLSATAESAAALLAS
                ||||||||||||||||||||:|||||||||||||||||||||||:|||||||||||||||
orf10ng-1       AGLEQLGVYSMGISFGGAALLLQSIFSTVWTPYIFRAIEENATPARLSATAESAAALLAS
                250       260       270       280       290       300

310       320       330       340       350       360
orf10-1.pep     ALCLTGIFSPLASLLLPENYAAVRFIVVSCMLPPLFCTLAEISGIGLNVVRKTRPIALAT
                |||||||||||||||||||||||||:|||||||||||||:|||||||||||||||||||
orf10ng-1       ALCLTGIFSPLASLLLPENYAAVRFTVVSCMLPPLFYTLTEISGIGLNVVRKTRPIALAT
                310       320       330       340       350       360

370       380       390       400       410       420
orf10-1.pep     LGALAANLLLLGLAVPSGGARGAAVACAASFWLFFAFKTESSCRLWQPLKRLPLYLHTLF
                |||||||||||||||||||||:||||||||||||||:|||||||||||||||||||:|||
orf10ng-1       LGALAANLLLLGLAVPSGGTRGAAVACAASFWLFFVFKTESSCRLWQPLKRLPLYMHTLF
                370       380       390       400       410       420

430       440       450       460       470
orf10-1.pep     CLTSSAAYTCFGTPANYPLFAGVWAAYLAGCILRHRKDLHKLFHYLKKQGFPLX
                ||:||||||||||||||||||||||||||||||||:||||||||||||||||||
orf10ng-1       CLASSAAYTCFGTPANYPLFAGVWAAYLAGCILRHRKNLHKLFHYLKKQGFPLX
                430       440       450       460       470
```

Based on this analysis, including the presence of a putative leader peptide and several transmembrane segments and the presence of a leucine-zipper motif (4 Leu residues spaced by 6 aa, shown in bold), it is predicted that these proteins from *N. meningitidis* and *N. gonorrhoeae*, and their epitopes, could be useful antigens for vaccines or diagnostics, or for raising antibodies.

Example 45

The following partial DNA sequence was identified in *N. meningitidis* <SEQ ID 381>:

```
  1..ATCCTGAAAC CGCATAACCA GCTTAAGGAA GACATCCAAC CTGATCCGGC

51   CGATCAAAAC GCCTTGTCCG AACCGGATGC TGCGACAGAG GCAGAGCAGT

101   CGGATGCGGA AAATGCTGCC GACAAGCAGC CCGTTGCCGA TAAAGCCGAC

151   GAGGTTGAAG AAAAGGCGGG CGAGCCGGAA CGGGAAGAGC CGGACGGACA

201   GGCAGTGCGT AAGAAAGCGC TGACGGAAGA GCGTGAACAA ACCGTCAGGG

251   AAAAAGCGCA GAAGAAAGAT GCCGAAACGG TTAAAATACA AGCGGTAAAA

301   CCGTCTAAAG AAACAGAGAA AAAAGCTTCA AAGAAGAGA AAAAGGCGGC

351   GAAGGAAAAA GTTGCACCCA AACCAACCCC GGAACAAATC CTCAACAGCG

401   GCAgCATCGA AAAmGCGCGC AgTGCCGCCG CCAAAGAAGT GCAGAAAATG

451   AA.AACGTCC GACAAGGCGG AAGC.AACGC ATTATCTGCA AATGGGCGCG

501   TATGCCGACC GTCAGAGCGC GGAAGGGCAG CGTGCCAAAC TGGCAATCTT

551   GGGCATATCT TCCAAGGTGG TCGGTTATCA GGCGGGACAT AAAACGCTTT

601   ACCGGGTGCA AGCGGCAAT ATGTCTGCCG ATGCGGTGA
```

This corresponds to the amino acid sequence <SEQ ID 382; ORF65>:

```
  1 ..ILKPHNQLKE DIQPDPADQN ALSEPDAATE AEQSDAENAA DKQPVADKAD

51   EVEEKAGEPE REEPDGQAVR KKALTEEREQ TVREKAQKKD AETVKIQAVK
```

```
101  PSKETEKKAS KEEKKAAKEK VAPKPTPEQI LNSGSIEXAR SAAAKEVQKM

151  XNVRQGGSXR IICKWARMPT VRARKGSVPN WQSWAYLPRW SVIRRDIKRF

201  TGCKAAICLP MR*
```

Further work revealed the complete nucleotide sequence <SEQ ID 383>:

```
  1  ATGTTTATGA ACAAATTTTC CCAATCCGGA AAAGGTCTGT CCGGTTTTTT

51  CTTCGGTTTG ATACTGGCGA CGGTCATTAT TGCCGGTATT TTGTTTTATC

101  TGAACCAGAG CGGTCAAAAT GCGTTCAAAA TCCCGGCTTC GTCGAAGCAG

151  CCTGCAGAAA CGGAAATCCT GAAACCGAAA AACCAGCCTA AGGAAGACAT

201  CCAACCTGAA CCGGCCGATC AAAACGCCTT GTCCGAACCG GATGCTGCGA

251  CAGAGGCAGA GCAGTCGGAT GCGGAAAAAG CTGCCGACAA GCAGCCCGTT

301  GCCGATAAAG CCGACGAGGT TGAAGAAAAG GCGGGCGAGC CGGAACGGGA

351  AGAGCCGGAC GGACAGGCAG TGCGTAAGAA AGCGCTGACG GAAGAGCGTG

401  AACAAACCGT CAGGGAAAAA GCGCAGAAGA AAGATGCCGA AACGGTTAAA

451  AAACAAGCGG TAAAACCGTC TAAAGAAACA GAGAAAAAG CTTCAAAAGA

501  AGAGAAAAAG GCGGCGAAGG AAAAAGTTGC ACCCAAACCA ACCCCGGAAC

551  AAATCCTCAA CAGCGGCAGC ATCGAAAAAG CGCGCAGTGC CGCCGCCAAA

601  GAAGTGCAGA AAATGAAAAC GTCCGACAAG GCGGAAGCAA CGCATTATCT

651  GCAAATGGGC GCGTATGCCG ACCGTCAGAG CGCGGAAGGG CAGCGTGCCA

701  AACTGGCAAT CTTGGGCATA TCTTCCAAGG TGGTCGGTTA TCAGGCGGGA

751  CATAAAACGC TTTACCGGGT GCAAAGCGGC AATATGTCTG CCGATGCGGT

801  GAAAAAAATG CAGGACGAGT TGAAAAAACA TGAAGTCGCC AGCCTGATCC

851  GTTCTATCGA AAGCAAATAA
```

This corresponds to the amino acid sequence <SEQ ID 384; ORF65-1>:

```
  1  MFMNKFSQSG KGLSGFFFGL ILATVIIAGI LFYLNQSGQN AFKIPASSKQ

51  PAETEILKPK NQPKEDIQPE PADQNALSEP DAATEAEQSD AEKAADKQPV

101  ADKADEVEEK AGEPEREEPD GQAVRKKALT EEREQTVREK AQKKDAETVK

151  KQAVKPSKET EKKASKEEKK AAKEKVAPKP TPEQILNSGS IEKARSAAAK

201  EVQKMKTSDK AEATHYLQMG AYADRQSAEG QRAKLAILGI SSKVVGYQAG

251  HKTLYRVQSG NMSADAVKKM QDELKKHEVA SLIRSIESK*
```

Computer analysis of this amino acid sequence gave the following results:

Homology with a Predicted ORF from *N. meningitidis* (Strain A)

ORF65 shows 92.0% identity over a 150aa overlap with an ORF (ORF65a) from strain A of *N. meningitidis*:

```
                                  10         20         30
orf65.pep                ILKPHNQLKEDIQPDPADQNALSEPDAATE
                         ||||:||  |||||| :||||||||||||| |
orf65a    IIAGILFYLNQSGQNAFKIPVPSKQPAETEILKPKNQPKEDIQPEPADQNALSEPDAAKE
          30         40         50         60         70         80
                   40         50         60         70         80         90
orf65.pep  AEQSDAENAADKQPVADKADEVEEKAGEPEREEPDGQAVRKKALTEEREQTVREKAQKKD
           ||||||:|||||||||||||||||||||:|||||:|||||||||||||||||:||||||
orf65a     AEQSDAEKAADKQPVADKADEVEEKADEPEREKSDGQAVRKKALTEEREQTVGEKAQKKD
                   90        100        110        120        130        140
                  100        110        120        130        140        150
orf65.pep  AETVKIQAVKPSKETEKKASKEEKKAAKEKVAPKPTPEQILNSGSIEXARSAAAKEVQKM
           ||||| ||||||||||||||||||||| |||||||||||||||||||||||||||||||
orf65a     AETVKKQAVKPSKETEKKASKEEKKAEKEKVAPKPTPEQILNSGSIEKARSAAAKEVQKM
                  150        160        170        180        190        200
                  160        170        180        190        200        210
orf65.pep  XNVRQGGSXRIICKWARMPTVRARKGSVPNWQSWAYLPRWSVIRRDIKRFTGCKAAICLP orf65a     KTPDKAEATHYLQMGAYADRRSAEGQRAKLAILGISSKVVGYQAGHKTLYRVQSGNMSAD
                  210        220        230        240        250        260
```

The complete length ORF65a nucleotide sequence <SEQ ID 385> is:

```
  1 ATGTTTATGA ACAAATTTTC CCAATCCGGA AAAGGTCTGT CCGGTTTTTT

51 CTTCGGTTTG ATACTGGCGA CGGTCATTAT TGCCGGTATT TTGTTTTATC

101 TGAACCAGAG CGGTCAAAAT GCGTTCAAAA TCCCGGTTCC GTCGAAGCAG

151 CCTGCAGAAA CGGAAATCCT GAAACCGAAA AACCAGCCTA AGGAAGACAT

201 CCAACCTGAA CCGGCCGATC AAAACGCCTT GTCCGAACCG GATGCTGCGA

251 AAGAGGCAGA GCAGTCGGAT GCGGAAAAAG CTGCCGACAA GCAGCCCGTT

301 GCCGACAAAG CCGACGAGGT TGAGGAAAAG GCGGACGAGC CGGAGCGGGA

351 AAAGTCGGAC GGACAGGCAG TGCGCAAGAA AGCACTGACG GAAGAGCGTG

401 AACAAACCGT CGGGGAAAAA GCGCAGAAGA AGATGCCGA AACGGTTAAA

451 AAACAAGCGG TAAAACCATC TAAAGAAACA GAGAAAAAAG CTTCAAAAGA

501 AGAGAAAAAG GCGGAGAAGG AAAAAGTTGC ACCCAAACCG ACCCCGGAAC

551 AAATCCTCAA CAGCGGCAGC ATCGAAAAAG CGCGCAGTGC CGCTGCCAAA

601 GAAGTGCAGA AAATGAAAAC GCCCGACAAG GCGGAAGCAA CGCATTATCT

651 GCAAATGGGC GCGTATGCCG ACCGCCGGAG CGCGGAAGGG CAGCGTGCCA

701 AACTGGCAAT CTTGGGCATA TCTTCCAAGG TGGTCGGTTA TCAGGCGGGA

751 CATAAAACGC TTTACCGGGT GCAAAGCGGC AATATGTCTG CCGATGCGGT

801 GAAAAAAATG CAGGACGAGT TGAAAAAACA TGAAGTCGCC AGCCTGATCC

851 GTTCTATCGA AAGCAAATAA
```

This encodes a protein having amino acid sequence <SEQ ID 386>:

```
  1 MFMNKFSQSG KGLSGFFFGL ITLATVIIAGI LFYLNQSGQN AFKIPVPSKQ

51 PAETEILKPK NQPKEDIQPE PADQNALSEP DAAKEAEQSD AEKAADKQPV

101 ADKADEVEEK ADEPEREKSD GQAVRKKALT EEREQTVGEK AQKKDAETVK

151 KQAVKPSKET EKKASKEEKK AEKEKVAPKP TPEQILNSGS IEKARSAAAK
```

-continued

```
201 EVQKMKTPDK AEATHYLQMG AYADRRSAEG QRAKLAILGI SSKVVGYQAG

251 HKTLYRVQSG NMSADAVKKM QDELKKHEVA SLIRSIESK*
```

ORF65a and ORF65-1 show 96.5% identity in 289 aa overlap:

```
                    10         20         30         40         50         60
orf65a.pep  MFMNKFSQSGKGLSGFFFGLILATVIIAGILFYLNQSGQNAFKIPVPSKQPAETEILKPK
            ||||||||||||||||||||||||||||||||||||||||||:|||||||||||||||
orf65-1     MFMNKFSQSGKGLSGFFFGLILATVIIAGILFYLNQSGQNAFKIPASSKQPAETEILKPK
                    10         20         30         40         50         60
                    70         80         90        100        110        120
orf65a.pep  NQPKEDIQPEPADQNALSEPDAAKEAEQSDAEKAADKQPVADKADEVEEKADEPEREKSD
            |||||||||||||||||||||||:||||||||||||||||||||||||||||:|||||:|
orf65-1     NQPKEDIQPEPADQNALSEPDAATEAEQSDAEKAADKQPVADKADEVEEKAGEPEREEPD
                    70         80         90        100        110        120
                   130        140        150        160        170        180
orf65a.pep  GQAVRKKALTEEREQTVGEKAQKKDAETVKKQAVKPSKETEKKASKEEKKAEKEKVAPKP
            ||||||||||||||||||:|||||||||||||||||||||||||||||||:|||||||
orf65-1     GQAVRKKALTEEREQTVREKAQKKDAETVKKQAVKPSKETEKKASKEEKKAAKEKVAPKP
                   130        140        150        160        170        180
                   190        200        210        220        230        240
orf65a.pep  TPEQILNSGSIEKARSAAAKEVQKMKTPDKAEATHYLQMGAYADRRSAEGQRAKLAILGI
            |||||||||||||||||||||||||||||:|||||||||||||||||:||||||||||
orf65-1     TPEQILNSGSIEKARSAAAKEVQKMKTSDKAEATHYLQMGAYADRQSAEGQRAKLAILGI
                   190        200        210        220        230        240
                   250        260        270        280        290
orf65a.pep  SSKVVGYQAGHKTLYRVQSGNMSADAVKKMQDELKKHEVASLIRSIESKX
            ||||||||||||||||||||||||||||||||||||||||||||||||||
orf65-1     SSKVVGYQAGHKTLYRVQSGNMSADAVKKMQDELKKHEVASLIRSIESKX
                   250        260        270        280        290
```

Homology with a Predicted ORF from *N. gonorrhoeae*

ORF65 shows 89.6% identity over a 212aa overlap with a predicted ORF (ORF65.ng) from *N. gonorrhoeae*:

```
                    30         40         50         60         70         80
ORF65ng     IIAGILLYLNQGGQNAFKIPAPSKQPAETEILKLKNQPKEDIQPEPADQNALSEPDVAKE
                                           |||:||  ||||||:||||||||||||||:||
ORF65                                      ILKPHNQLKEDIQPDPADQNALSEPDAATE
                                                       10         20         30
                    90        100        110        120        130        140
ORF65ng     AEQSDAEKAADKQPVADKADEVEEKAGEPEREEPDGQAVRKKALTEEREQTVREKAQKKD
            |||||||:|||||||||||||||||||||||||||||||||||||||||||||||||||
ORF65       AEQSDAENAADKQPVADKADEVEEKAGEREREEPDGQAVRKKALTEEREQTVREKAQKKD
                    40         50         60         70         80         90
                   150        160        170        180        190        200
ORF65ng     AETVKKKAVKPSKETEKKASKEEKKAAKEKVAPKPTPEQILNSRSIEKARSAAAKEVQKM
            |||||:||||||||||||||||||||||||||||||||||||||:|||||||||||||
ORF65       AETVKIQAVKPSKETEKKASKEEKKAAKEKVAPKPTPEQILNSGSIEXARSAAAKEVQKM
                        100        110        120        130        140        150
                   210        220        230        240        250        260
ORF65ng     KNFGQGGSQRIICKWARMPNPGARKGSVPNWQSWAYLPKWSAIRRDIKRFTACKAAICPP
            :|||:||| ||||||||||||:|:||||||||||||||||:||||||||||||:||| 
ORF65       XNVRQGGSXRIICKWARMPTVRARKGSVPNWQSWAYLPRWSVIRRDIKRFTGCKAAICLP
                        160        170        180        190        200        210

ORF65ng     MR
            ||
ORF65       MR
```

An ORF65ng nucleotide sequence <SEQ ID 387> was predicted to encode a protein having amino acid sequence <SEQ ID 388>:

```
  1 MFMNKFSQSG KGLSGFFFGL ILATVIIAGI LLYLNQGGQN AFKIPAPSKQ

51 PAETEILKLK NQPKEDIQPE PADQNALSEP DVAKEAEQSD AEKAADKQPV

101 ADKADEVEEK AGEPEREEPD GQAVRKKALT EEREQTVREK AQKKDAETVK

151 KKAVKPSKET EKKASKEEKK AAKEKVAPKP TPEQILNSRS IEKARSAAAK

201 EVQKMKNFGQ GGSQRIICKW ARMPNPGARK GSVPNWQSWA YLPKWSAIRR

251 DIKRFTACKA AICPPMR*
```

After further analysis, the complete gonococcal DNA sequence <SEQ ID 389> was found to be:

```
  1 ATGTTTATGA ACAAATTTTC CCAATCCGGA AAAGGTCTGT CCGGTTTCTT

51 CTTCGGTTTG ATACTGGCAA CGGTCATTAT TGCCGGTATT TTGCTTTATC

101 TGAACCAGGG CGGTCAAAAT GCGTTCAAAA TCCCGGCTCC GTCGAAGCAG

151 CCTGCAGAAA CGGAAATCCT GAAACTGAAA AACCAGCCTA AGGAAGACAT

201 CCAACCTGAA CCGGCCGATC AAAACGCCTT GTCCGAACCG GATGTTGCGA

251 AAGAGGCAGA GCAGTCGGAT GCGGAAAAAG CTGCCGACAA GCAGCCCGTT

301 GCCGACAAag ccgacgAGGT TGAAGAAAag GcGGgcgAgc cggaACGGga 351 aGAGCCGGAC ggACAGGCAG TGCGCAAGAA AGCACTGAcg gAAGAgcGTG 401 AACAAACcgt cagggAAAAA GCGCagaaga AAGATGCCGA AACGgTTAAA 451 AAacaaGCgg tAaaaccgtc tAAAGAAACa gagaaaaaag cTtcaaaaga 501 agagaaaaag gcggcgaaag aaaAAGttgc acccaaaccg accccggaaC 551 aaatcctcaa cagccgCagc atcgaaaaag cgcgtagtgc cgctgccaaa 601 gaAgtgcaGA AAatgaaaaa ctTtgggcaa ggcgGaagcc aacgcattaT 651 CTGcaaatgg gcgcgtatgc cgaccgtccg gagcgcggaA gggcagcgtg 701 ccaaACtggc aAtcttgGgc atatctTccg aagtggtcgG CTATCAGGCG 751 GGACATAAAA CGCTTTACCG CGTGCAAagc GGCAatatgt ccgccgatgc 801 gGTGAAAAAA ATGCAGGACG AGTTGAAAAA GCATGGGGtt gcCAGCCTGA 851 TCCGTGcgAT TGAAGGCAAA TAA
```

This encodes the following amino acid sequence <SEQ ID 390>:

```
  1 MFMNKFSQSG KGLSGFFFGL ILATVIIAGI LLYLNQGGQN AFKIPAPSKQ

51 PAETEILKLK NQPKEDIQPE PADQNALSEP DVAKEAEQSD AEKAADKQPV

101 ADKADEVEEK AGEPEREEPD GQAVRKKALT EEREQTVREK AQKKDAETVK

151 KQAVKPSKET EKKASKEEKK AAKEKVAPKP TPEQILNSRS IEKARSAAAK

201 EVQKMKNFGQ GGSQRIICKW ARMPTVRSAE GQRAKLAILG ISSEVVGYQA

251 GHKTLYRVQS GNMSADAVKK MQDELKKHGV ASLIRAIEGK *
```

ORF65ng-1 and ORF65-1 show 89.0% identity in 290 aa overlap:

```
                   10         20         30         40         50         60
    orf65-1.pep  MFMNKFSQSGKGLSGFFFGLILATVIIAGILFYLNQSGQNAFKIPASSKQPAETEILKPK
                 ||||||||||||||||||||||||||||:||||:|||||||||| |||||||||||| |
    orf65ng-1    MFMNKFSQSGKGLSGFFFGLILATVIIAGILLYLNQGGQNAFKIPAPSKQPAETEILKLK
                   10         20         30         40         50         60

70         80         90        100        110        120
    orf65-1.pep  NQPKEDIQPEPADQNALSEPDAATEAEQSDAEKAADKQPVADKADEVEEKAGEPEREEPD
                 ||||||||||||||||||||||:|||||||||||||||||||||||||||||||||||||
    orf65ng-1    NQPKEDIQPEPADQNALSEPDVAKEAEQSDAEKAADKQPVADKADEVEEKAGEPEREEPD
                   70         80         90        100        110        120

130        140        150        160        170        180
    orf65-1.pep  GQAVRKKALTEEREQTVREKAQKKDAETVKKQAVKPSKETEKKASKEEKKAAKEKVAPKP
                 ||||||||||||||||||||||||||||||||||||||||||||||||||||||||||||
    orf65ng-1    GQAVRKKALTEEREQTVREKAQKKDAETVKKQAVKPSKETEKKASKEEKKAAKEKVAPKP
                  130        140        150        160        170        180

190        200        210        220        230        239
    orf65-1.pep  TPEQILNSGSIEKARSAAAKEVQKMKTSDKAEATHYL-QMGAYADRQSAEGQRAKLAILG
                 ||||||||:::::::::::::||:::|:::|::: :   ::|||||||||||||||||||
    orf6ng5-1    TPEQILNSRSIEKARSAAAKEVQKMKNFGQGGSQRIICKWARMPTVRSAEGQRAKLAILG
                  190        200        210        220        230        240

240        250        260        270        280        290
    orf65-1.pep  ISSKVVGYQAGHKTLYRVQSGNMSADAVKKMQDELKKHEVASLIRSIESKX
                 |||:|||||||||||||||||||||||||||||||||||||||:|:|:||
    orf65ng-1    ISSEVVGYQAGHKTLYRVQSGNMSADAVKKMQDELKKHGVASLIRAIEGKX
                  250        260        270        280        290
```

On this basis, including the presence of a putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 46

The following DNA sequence, believed to be complete, was identified in *N. meningitidis* <SEQ ID 391>:

```
  1 ATGAACCACG ACATCACTTT CCTCACCCTG TTCCTACTCG GTkTCTTCGG

51 CGGAAcGCAC TGCATCGGTA TGTGCGGCGG ATTAAGCAGC GcGTTTGs.s

101 TCCAACTCCC CCCGCATATC AACCGCTTTT GGCTGATCCT GCTGCTTAAC

151 ACAGGACGGG TAAGCAGCTA TACGGCAAtC GGCCTGATAC TCGGATTAAT

201 CGGACAGGTC GGCGTTTCAC TCGAcCAaAC CCGCGTCCTG CAGAATATTT

251 TATACACGGC CGCCAACCTC CTGCTGCTCT TTTTAGGCTT ATACTTGAGC

301 GGTATTTCTT CCTTGGCGGC AAAAATCGAG AAaATCGGCA AACCGATATG

351 GCGGAACCTG AACCCGATAC TCAACCGGCT GTTACCCATA AAATCCATAC

401 CCGCCTGCCT tGCGgTCGGA ATATTATGGG GCTGGCTGCC GTGCGGACTG

451 GTTTACAGCG CGTCGCTTTA CGCGCTGGGA AgCGGTAGTG CGGCAACGGG

501 CGGGTTATAT ATGCTTGCCT TTGCACTGGG TACGCTGCCC AATCTTtTAG

551 CAATCGGCAT TTTtTCCCTG CAACTGAAwA AAATCATGCA AAACCGATAT

601 ATCCGCCTGT GTACGGGATT ATCCGTATCA TTATGGGCAT TATGGAAACT

651 TGCCGTCCTG TGGCTGTAA
```

This corresponds to the amino acid sequence <SEQ ID 392; ORF103>:

```
  1 MNHDITFLTL FLLGXFGGTH CIGMCGGLSS AFXXQLPPHI NRFWLILLLN

51 TGRVSSYTAI GLILGLIGQV GVSLDQTRVL QNILYTAANL LLLFLGLYLS

101 GISSLAAKIE KIGKPIWRNL NPILNRLLPI KSIPACLAVG ILWGWLPCGL

151 VYSASLYALG SGSAATGGLY MLAFALGTLP NLLAIGIFSL QLXKIMQNRY

201 IRLCTGLSVS LWALWKLAVL WL*
```

Further work elaborated the DNA sequence <SEQ ID 393> as:

```
  1 ATGAACCACG ACATCACTTT CCTCACCCTG TTCCTACTCG
    GTTTCTTCGG

51 CGGAACGCAC TGCATCGGTA TGTGCGGCGG ATTAAGCAGC
    GCGTTTGCGC

101 TCCAACTCCC CCCGCATATC AACCGCTTTT GGCTGATCCT
    GCTGCTTAAC

151 ACAGGACGGG TAAGCAGCTA TACGGCAATC GGCCTGATAC
    TCGGATTAAT

201 CGGACAGGTC GGCGTTTCAC TCGACCAAAC CCGCGTCCTG
    CAGAATATTT

251 TATACACGGC CGCCAACCTC CTGCTGCTCT TTTTAGGCTT
    ATACTTGAGC

301 GGTATTTCTT CCTTGGCGGC AAAAATCGAG AAAATCGGCA
    AACCGATATG

351 GCGGAACCTG AACCCGATAC TCAACCGGCT GTTACCCATA
    AAATCCATAC

401 CCGCCTGCCT TGCGGTCGGA ATATTATGGG CTGGCTGCC
    CTGCGGACTG

451 GTTTACAGCG CGTCGCTTTA CGCGCTGGGA AGCGGTAGTG
    CGGCAACGGG

501 CGGGTTATAT ATGCTTGCCT TTGCACTGGG TACGCTGCCC
    AATCTTTTAG

551 CAATCGGCAT TTTTTCCCTG CAACTGAAAA AAATCATGCA
    AAACCGATAT

601 ATCCGCCTGT GTACGGGATT ATCCGTATCA TTATGGGCAT
    TATGGAAACT

651 TGCCGTCCTG TGGCTGTAA
```

This corresponds to the amino acid sequence <SEQ ID 394; ORF103-1>:

```
  1 MNHDITFLTL FLLGFFGGTH CIGMCGGLSS AFALQLPPHI
    NRFWLILLLN

51 TGRVSSYTAI GLILGLIGQV GVSLDQTRVL QNILYTAANL
    LLLFLGLYLS

101 GISSLAAKIE KIGKPIWRNL NPILNRLLPI KSIPACLAVG
    ILWGWLPCGL

151 VYSASLYALG SGSAATGGLY MLAFALGTLP NLLAIGIFSL
    QLKKIMQNRY

201 IRLCTGLSVS LWALWKLAVL WL*
```

Computer analysis of this amino acid sequence gave the following results:

Homology with a Predicted ORF from *N. meningitidis* (Strain A)

ORF103 shows 93.8% identity over a 222aa overlap with an ORF (ORF103a) from strain A of *N. meningitidis*:

```
                        10        20        30        40        50        60
            orf103.pep  MNHDITFLTLFLLGXFGGTHCIGMCGGLSSAFXXQLPPHINRFWLILLLNTGRVSSYTAI
                        ||||||||||||||  |||||||||||||||||  |||||||| ||||||||||||||||
            orf103a     MNXDITFLTLFLLGFFGGTHCIGMCGGLSSAFALQLPPHINRXWLILLLNTGRVSSYTAI
                        10        20        30        40        50        60

70        80        90       100       110       120
            orf103.pep  GLILGLIGQVGVSLDQTRVLQNILYTAANLLLLFLGLYLSGISSLAAKIEKIGKPIWRNL
                        |||||||||||||||||||| |||||||||||||||||||||||||||||||||||||||
            orf103a     GLILGLIGQVGVSLDQTRVXQNILYTAANLLLLFLGLYLSGISSLAAKIEKIGKPIWRNL
                              70        80        90       100       110       120

130       140       150       160       170       180
            orf103.pep  NPILNRLLPIKSIPACLAVGILWGWLPCGLVYSASLYALGSGSAATGGLYMLAFALGTLP
                        ||||||||||||||||||||||||||||||||||||||||||||||||||||||||||||
            orf103a     NPILNRLLPIKSIPACLAVGILWGWLPCGLVYSASLYALGSGSAATGGLYMLAFALGTLP
                              130       140       150       160       170       180
                              190       200       210       220
            orf103.pep  NLLAIGIFSLQLXKIMQNRYIRLCTGLSVSLWALWKLAVLWLX
                        |||||||||||| |||||||||||||||||||||||||||||
            orf103a     NLXAIGIFSLQLXKIMQNRYIRLCTGLSVSLWALWKLAVLWLX
                              190       200       210       220
```

The complete length ORF103a nucleotide sequence <SEQ ID 395> is:

```
  1 ATGAACCANG ACATCACTTT CCTCACCCTG TTCCTACTCG
    GTTTCTTCGG
 51 CGGAACGCAC TGCATCGGTA TGTGCGGCGG ATTAAGCAGC
    GCGTTTGCGC
101 TCCAACTCCC CCCGCATATC AACCGCTTNT GGCTGATCCT
    GCTGCTTAAC
151 ACAGGACGGG TAAGCAGCTA TACGGCAATC GGCCTGATAC
    TCGGATTAAT
201 CGGACAGGTC GGCGTTTCAC TCGACCAAAC CCGCGTCNTG
    CAGAATATTT
251 TATACACGGC CGCCAACCTC CTGCTGCTCT TTTTAGGCTT
    ATACTTGAGC
301 GGTATTTCTT CCTTGGCGGC AAAAATCGAG AAAATCGGCA
    AACCGATATG
351 GCGGAACCTG AACCCGATAC TCAACCGGCT GTTACCCATA
    AAATCCATAC
401 CCGCCTGCCT TGCGGTCGGA ATATTATGGG GCTGGCTGCC
    GTGCGGACTA
451 GTTTACAGCG CGTCGCTTTA CGCGCTGGGA AGCGGTAGTG
    CGGCAACGGG
501 CGGGTTATAT ATGCTTGCCT TTGCACTGGG TACGCTGCCC
    AATCTTTNGG
551 CAATCGGCAT TTTTTCCCTG CAACTGNAAA AAATCATGCA
    AAACCGATAT
601 ATCCGCCTGT GTACGGGATT ATCCGTATCA TTATGGGCAT
    TATGGAAACT
651 TGCCGTCCTG TGGCTGTAA
```

This encodes a protein having amino acid sequence <SEQ ID 396>:

```
  1 MNXDITFLTL FLLGFFGGTH CIGMCGGLSS AFALQLPPHI
    NRXWLILLLN
 51 TGRVSSYTAI GLILGLIGQV GVSLDQTRVX QNILYTAANL
    LLLFLGLYLS
101 GISSLAAKIE KIGKPIWRNL NPILNRLLPI KSIPACLAVG
    ILWGWLPCGL
151 VYSASLYALG SGSAATGGLY MLAFALGTLP NLXAIGIFSL
    QLXKIMQNRY
201 IRLCTGLSVS LWALWKLAVL WL*
```

ORF103a and ORF103-1 show 97.7% identity in 222 aa overlap:

```
                        10         20         30         40         50         60
orf103a.pep  MNXDITFLTLFLLGFFGGTHCIGMCGGLSSAFALQLPPHINRXWLILLLNTGRVSSYTAI
             || |||||||||||||||||||||||||||||||||||||||| ||||||||||||||||
orf103-1     MNHDITFLTLFLLGFFGGTHCIGMCGGLSSAFALQLPPHINRFWLILLLNTGRVSSYTAI
                        10         20         30         40         50         60

70         80         90        100        110        120
orf103a.pep  GLILGLIGQVGVSLDQTRVXQNILYTAANLLLLFLGLYLSGISSLAAKIEKIGKPIWRNL
             ||||||||||||||||||||| ||||||||||||||||||||||||||||||||||||||
orf103-1     GLILGLIGQVGVSLDQTRVLQNILYTAANLLLLFLGLYLSGISSLAAKIEKIGKPIWRNL
                        70         80         90        100        110        120

130        140        150        160        170        180
orf103a.pep  NPILNRLLPIKSIPACLAVGILWGWLPCGLVYSASLYALGSGSAATGGLYMLAFALGTLP
             ||||||||||||||||||||||||||||||||||||||||||||||||||||||||||||
orf103-1     NPILNRLLPIKSIPACLAVGILWGWLPCGLVYSASLYALGSGSAATGGLYMLAFALGTLP
                       130        140        150        160        170        180

190        200        210        220
orf103a.pep  NLXAIGIFSLQLXKIMQNRYIRLCTGLSVSLWALWKLAVLWLX
             || ||||||||| |||||||||||||||||||||||||||||
orf103-1     NLLAIGIFSLQLKKIMQNRYIRLCTGLSVSLWALWKLAVLWLX
                       190        200        210        220
```

Homology with a Predicted ORF from *N. gonorrhoeae*
ORF103 shows 95.5% identity over a 222aa overlap with a predicted ORF (ORF103.ng) from *N. gonorrhoeae*:

```
orf103.pep   MNHDITFLTLFLLGXFGGTHCIGMCGGLSSAFXXQLPPHINRFWLILLLNTGRVSSYTAI   60
             ||||||||||||||  ||||||||||||||||||  ||||||||||||||||| ||||||
orf103ng     MNHDITFLTLFLLGFFGGTHCIGMCGGLSSAFALQLPPHINRFWLILLLNTGRISSYTAI   60 orf103.pep   GLILGLIGQVGVSLDQTRVLQNILYTAANLLLLFLGLYLSGISSLAAKIEKIGKPIWRNL  120
             | ||||||| | ||||||||||||||| ||||||||||||||||||||||||||||||||
orf103ng     GLMLGLIGQLGISLDQTRVLQNILYTASNLLLLFLGLYLSGISSLAAKIEKIGKPIWRNL  120 orf103.pep   NPILNRLLPIKSIPACLAVGILWGWLPCGLVYSASLYALGSGSAATGGLYMLAFALGTLP  180
             |||||||||||||||||||||||||||||||||||||||||||||||| |||||||||||
orf103ng     NPILNRLLPIKSIPACLAVGILWGWLPCGLVYSASLYALGSGSAATTGGLYMLAFALGTLP  180 orf103.pep   NLLAIGIFSLQLXKIMQNRYIRLCTGLSVSLWALWKLAVLWL  222
             ||||||||||| |||||||||||||||||||||||||||||
orf103ng     NLLAIGIFSLQLKKIMQNRYIRLCTGLSVSLWALWKLAVLWL  222
```

The complete length ORF103ng nucleotide sequence <SEQ ID 397> is:

```
  1 ATGAACCACG ACATCACTTT CCTCACCCTG TTCCTGCTCG
    GTTTCTTCGG

51 CGGAACTCAC TGCATCGGTA TGTGCGGCGG ATTAAGCAGC
    GCGTTTGCGC

101 TCCAACTCCC CCCGCATATC AACCGCTTTT GGCTGATTCT
    GCTGCTTAAC

151 ACAGGACGGA TAAGCAGCTA TACGGCAATC GGCCTGATGC
    TCGGATTAAT

201 CGGACAACTC GGCATTTCAC TCGACCAAAc ccgcgTCCTG
    CAAAATATTT 251 tatacacagc ctccaaCCTC CTGCTGCTCT TTTTAGGCTT
    ATACTTGAGC

301 GGTATTTCTT CCTTGGCGGC AAAAATCGAG AAAATCGGCA
    AACCGATATG

351 GCGCAACCTG AACCCGATAC TCAACCGGCT GCTGCCCATA
    AAATCCATAC

401 CCGCCTGCCT TGCTGTCGGA ATATTATGGG GCTGGCTGCC
    GTGCGGACTG

451 GTTTACAGCG CATCACTTTA CGCGCTGGGA AGCGGTAGTG
    CGACAACCGG

501 CGGACTGTAT ATGCTTGCCT TTGCACTGGG TACGCTGCCC
    AATCTTTTGG

551 CAATCGGCAT TTTTTCCCTG CAACTGAAAA AAATCATGCA
    AAACCGATAT

601 ATCCGCCTGT GTACAGGATT ATCCGTATCA TTATGGGCAT
    TATGGAAGCT

651 TGCCGTCCTG TGGCTGTAA
```

This encodes a protein having amino acid sequence <SEQ ID 398>:

```
  1 MNHDITFLTL FLLGFFGGTH CIGMCGGLSS AFALQLPPHI
    NRFWLILLLN

51 TGRISSYTAI GLMLGLIGQL GISLDQTRVL QNILYTASNL
    LLLFLGLYLS

101 GISSLAAKIE KIGKPIWRNL NPILNRLLPI KSIPACLAVG
    ILWGWLPCGL

151 VYSASLYALG SGSATTGGLY MLAFALGTLP NLLAIGIFSL
    QLKKIMQNRY

201 IRLCTGLSVS LWALWKLAVL WL*
```

In addition, ORF103ng and ORF103-1 show 97.3% identity in 222 aa overlap:

```
                    10        20        30        40        50        60
orf103-1.pep  MNHDITFLTLFLLGFFGGTHCIGMCGGLSSAFALQLPPHINRFWLILLLNTGRVSSYTAI
              ||||||||||||||||||||||||||||||||||||||||||||||||||||:||||||
orf103ng      MNHDITFLTLFLLGFFGGTHCIGMCGGLSSAFALQLPPHINRFWLILLLNTGRISSYTAI
                    10        20        30        40        50        60

70        80        90       100       110       120
orf103-1.pep  GLILGLIGQVGVSLDQTRVLQNILYTAANLLLLFLGLYLSGISSLAAKIEKIGKPIWRNL
              ||:||||||:|:||||||||||||||||:|||||||||||||||||||||||||||||||
orf103ng      GLMLGLIGQLGISLDQTRVLQNILYTASNLLLLFLGLYLSGISSLAAKIEKIGKPIWRNL
                    70        80        90       100       110       120

130       140       150       160       170       180
orf103-1.pep  NPILNRLLPIKSIPACLAVGILWGWLPCGLVYSASLYALGSGSAATGGLYMLAFALGTLP
              ||||||||||||||||||||||||||||||||||||||||||||:|||||||||||||||
orf103ng      NPILNRLLPIKSIPACLAVGILWGWLPCGLVYSASLYALGSGSATTGGLYMLAFALGTLP
                   130       140       150       160       170       180

190       200       210       220
orf103-1.pep  NLLAIGIFSLQLKKIMQNRYIRLCTGLSVSLWALWKLAVLWLX
              ||||||||||||||||||||||||||||||||||||||||||
orf103ng      NLLAIGIFSLQLKKIMQNRYIRLCTGLSVSLWALWKLAVLWLX
                   190       200       210       220
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 47

The following partial DNA sequence was identified in *N. meningitidis* <SEQ ID 399>:

```
  1 ATGGAAAACC AAAGGCCGCT CCTAGGCTTT CGCTTGGCAC
    TTTTGGCGGC

51 GATGACGTGG GGAACGCTGC CGAT.TCCGT GCGGCAGGTA
    TTGAAGTTTG

101 TCGATGCGCC GACGCTGGTG TGGGTGCGTT TTACCGTGGC
    GGCGGCGGTA

151 TTGTTTGTTT TGCTGGCACT GGGCGGGCGG CTGCcGAAGC
    GGCGaGGATT

201 TTTCTTGGTG CTCATTCAGG CTGCTGCTGC TCGGCGTGGC
    GGGCATTTCG

251 GCAAACTTTG TGCTGATTGC CCAAGGGCTG CATTATATTT
    CGCCGACCAC

301 GACGCAGGTT TTGTGGCAGA TTTCGCCGTT TACGATGATT
    GTwGTCGGTG

351 TGTTGGTGTT TAAAGACCGG ATGACTGCCG CTCAGAAAAT
    CGGCTTGGTT

401 TTGCTGCTTG CCGGTTTGCT TATGTATTTT AACGATAAAT
    TCGGCGAGTT

451 GTCGGGTTTG GGCGCGTATG C.AAGGGCGT GTTGCTGTGT
    GCGGCAGGCA

501 GTATGGCATG GGTGTGTAAT GCCGTGGCGC AAAAGCTGCT
    GTCGGCGCAA

551 TTCGGGCCGC AACAGATTCT GCTGTTGATT TATGCGGCAA
    GTGCCGCCGT

601 GTTCCTGCCG TTTGCCGAAC CGGCACACAT CGGAAGTATG
    GACGGTACGT

651 TGGCGTGGGT ATGTATTGCG TATTGCTGCT TGAATACGTT
    AATCGGTTAC

701 GGCTCGTTCG GCGAGGCGTT GAAACATTGG GAGGCTTCCA
    AAGTCAGCGC

751 GGTAACAACC TTGCTCCCCG TGTTTACCGT AATAAATACT
    TTGCTCGGGC

801 ATTATGTGAT GCCTGAAACT TTGCCGCGC CGGA . . .
```

This corresponds to the amino acid sequence <SEQ ID 400; ORF104>:

```
  1 MENQRPLLGF RLALLAAMTW GTLPXSVRQV LKFVDAPTLV
    WVRFTVAAAV

51 LFVLLALGGR LPKRRDFSWC SFRLLLLGVA GISANFVLIA
    QGLHYISPTT

101 TQVLWQISPF TMIVVGVLVF KDRMTAAQKI GLVLLLAGLL
    MYFNDKFGEL

151 SGLGAYXKGV LLCAAGSMAW VCNAVAQKLL SAQFGPQQIL
    LLIYAASAAV
```

```
201 FLPFAEPAHI CSMDGTLAWV CIAYCCLNTL IGYGSFGEAL
    KHWEASKVSA

251 VTTLLPVFTV INTLLGHYVM PETFAAP . . .
```

Further work revealed further partial DNA sequence <SEQ ID 401>:

```
  1 ATGGAAAACC AAAGGCCGCT CCTAGGCTTC GCGTTGGCAC
    TTTTGGCGGC

51 GATGACGTGG CGAACGCTGC CGATTGCCGT GCGGCAGGTA
    TTGAAGTTTG

101 TCGATGCGCC GACGCTGGTG TGGGTGCGTT TTACCGTGGC
    GGCGGCGGTA

151 TTGTTTGTTT TGCTGGCACT GGGCGGGCGG CTGCCGAAGC
    GGCGGGATTT

201 TTCTTGGTGC TCATTCAGGC TGCTGCTGCT CGGCGTGGCG
    GGCATTTCGG

251 CAAACTTTGT GCTGATTGCC CAAGGGCTGC ATTATATTTC
    GCCGACCACG

301 ACGCAGGTTT GTGGCAGAT TCGCCGTTT ACGATGATTG
    TTGTCGGTGT

351 GTTGGTGTTT AAAGACCGGA TGACTGCCGC TCAGAAAATC
    GGCTTGGTTT

401 TGCTGCTTGC CGGTTTGCTT ATGTTTTTA ACGATAAATT
    CGGCGAGTTG

451 TCGGGTTTGG GCGCGTATGC GAAGGGCGTG TTGCTGTGTG
    CGGCAGGCAG

501 TATGGCATGG GTGTGTTATG CCGTGGCGCA AAAGCTGCTG
    TCGGCGCAAT

551 TCGGGCCGCA ACAGATTCTG CTGTTGATTT ATGCGGCAAG
    TGCCGCCGTG

601 TTCCTGCCGT TTGCCGAACC GGCACACATC GGAAGTTTGG
    ACGGTACGTT

651 GGCGTGGGTT TGTTTTGCGT ATTGCTGCTT GAATACGTTA
    ATCGGTTACG

701 GCTCGTTCGG CGAGGCGTTG AAACATTGGG AGGCTTCCAA
    AGTCAGCGCG

751 GTAACAACCT TGCTCCCCGT GTTTACCGTA ATAwTwwCTT
    TGCTCGGGCA

801 TTATGTGATG CCTGAAACTT TGCCGCGCC GGA . . .
```

This corresponds to the amino acid sequence <SEQ ID 402; ORF104-1>:

```
  1 MENQRPLLGF ALALLAAMTW GTLPIAVRQV LKFVDAPTLV
    WVRFTVAAAV

51 LFVLLALGGR LPKRRDFSWC SFRLLLLGVA GISANFVLIA
    QGLHYISPTT

101 TQVLWQISPF TMIVVGVLVF KDRMTAAQKI GLVLLLAGLL
    MFFNDKFGEL

151 SGLGAYAKGV LLCAAGSMAW VCYAVAQKLL SAQFGPQQIL
    LLIYAASAAV

201 FLPFAEPAHI GSLDGTLAWV CFAYCCLNTL IGYGSFGEAL
    KHWEASKVSA

251 VTTLLPVFTV IXXLLGHYVM PETFAAP . . .
```

Computer analysis of this amino acid sequence gave the following results:

Homology with Hypothetical HI0878 Protein of *H. influenzae* (Accession Number U32769)

ORF104 and HI0878 show 40% aa identity in 277aa overlap:

```
orf104    4 QRPLLGFRLALLAAMTWGTLPXSVRQVLKFVDAPTLVWXXXXXXXXXXXXXXXXXXXXXP-    62
            Q+PLLGF  AL+ AM WG+LP +++QVL  ++A T+VW                     P
HI0878    3 QQPLLGFTFALITAMAWGSLPIALKQVLSVMNAQTIVWYRFIIAAVSLLALLAYKKQLPE    62 orf104   63 --KRRDFSWCSFRLLLLGVAGISANFVLIAQGLHYISPTTTQVLWQISPFTMIVVGVLVF   120
              K R ++W    ++L+GV G+++NF+L +   L+YI P+   Q+    +S F M++ GVL+F
HI0878   63 LMKVRQYAW----IMLIGVIGLTSNFLLFSSSLNYIEPSVAQIFIHLSSFGMLICGVLIF   118 orf104  121 KDRMTAAQKIXXXXXXXXXXXMYFNDKFGELSGLGAYXKGVLLCAAGSMAWVCNAVAQKLL   180
            K+++    QKI           ++FND+F  +GL Y GV+L  G++ WV     +AQKL+
HI0878  119 KEKLGLHQKIGLFLLLIGLGLFFNDRFDAFAGLNQYSTGVILGVGGALIWVAYGMAQKLM   178 orf104  181 SAQFGPQQILLLIYAASAAVFLPFAEPAHIGSMDGTLAWVCIAYCCLNTLIGYGSFGEAL   240
              +F  QQILL++Y  A  F+P A+ + +  +    LA +C  YCCLNTLIGYGS+ EAL
HI0878  179 LRKFNSQQILLMMYLGCAIAFMPMADFSQVQELT-PLALICFIYCCLNTLIGYGSYAEAL   237 orf104  241 KHWEASKVSAVTTLLPVFTVINTLLGHYVMPETFAAP                         277
              W+  SKVS V TL+P+FT++ +  + HY  P  FAAP
HI0878  238 NRWDVSKVSVVITLVPLFTILFSHIAHYFSPADFAAP                         274
```

Homology with a Predicted ORF from *N. meningitidis* (Strain A)

ORF104 shows 95.3% identity over a 277aa overlap with an ORF (ORF104a) from strain A of *N. meningitidis*:

```
                    10        20        30        40        50        60
orf104.pep  MENQRPLLGFRLALLAAMTWGTLPXSVRQVLKFVDAPTLVWVRFTVAAAVLFVLLALGGR
            ||||||||||:|||||||||||||:||||||||||||||||||||||||||||||||||
orf104a     MENQRPLLGFALALLAAMTWGTLPIAVRQVLKFVDAPTLVWVRFTVAAAVLFVLLALGGR
                    10        20        30        40        50        60

70        80        90       100       110       120
orf104.pep  LPKRRDFSWCSFRLLLLGVAGISANFVLIAQGLHYISPTTTQVLWQISPFTMIVVGVLVF
            |||:||||||||||||||||||||||||||||||||||||||||||||||||||||||||
orf104a     LPKWRDFSWCSFRLLLLGVAGISANFVLIAQGLHYISPTTTQVLWQISPFTMIVVGVLVF
                    70        80        90       100       110       120

130       140       150       160       170       180
orf104.pep  KDRMTAAQKIGLVLLLAGLLMYFNDKFGELSGLGAYXKGVLLCAAGSMAWVCNAVAQKLL
            ||||||||||||||||||||||:|||||||||||||:|||||||||||||||:|||||||
orf104a     KDRMTAAQKIGLVLLLAGLLMFFNDKFGELSGLGAYAKGVLLCAAGSMAWVCYAVAQKLL
                   130       140       150       160       170       180

190       200       210       220       230       240
orf104.pep  SAQFGPQQILLLIYAASAAVFLPFAEPAHIGSMDGTLAWVCIAYCCLNTLIGYGSFGEAL
            ||||||||||||||||||||||||||:|||||:||||||||:|||||||||||||||||
orf104a     SAQFGPQQILLLIYAASAAVFLPFAELAHIGSLDGTLAWVCFAYCCLNTLIGYGSFGEAL
                   190       200       210       220       230       240

250       260       270
orf104.pep  KHWEASKVSAVTTLLPVFTVINTLLGHYVMPETFAAP
            |||||||||||||||||||:||||||:||||||
orf104a     KHWEASKVSAVTTLLPVFTVIFSLLGHYVMPDTFAAPDMNGLGYAGALVVVGGAVTAAVG
                   250       260       270       280       290       300
```

The complete length ORF104a nucleotide sequence <SEQ ID 403> is:

```
  1 ATGGAAAACC AAAGGCCGCT CCTAGGCTTC GCGTTGGCAC TTTTGGCGGC

51 GATGACGTGG GGAACGCTGC CGATTGCCGT GCGGCAGGTA TTGAAGTTTG

101 TCGATGCGCC GACGCTGGTG TGGGTGCGTT TTACCGTGGC GGCGGCGGTA

151 TTGTTTGTTT TGCTGGCATT GGGCGGGCGG CTGCCGAAGT GGCGGGATTT

201 TTCTTGGTGC TCATTCAGGC TGCTGCTGCT CGGCGTGGCG GGCATTTCGG
```

```
                       -continued
251  CAAACTTTGT GCTGATTGCC CAAGGGCTGC ATTATATTTC GCCGACCACG

301  ACGCAGGTTT TGTGGCAGAT TTCGCCGTTT ACGATGATTG TTGTCGGTGT

351  GTTGGTGTTT AAAGACCGGA TGACTGCCGC TCAGAAAATC GGCTTGGTTT

401  TGCTGCTTGC CGGTTTGCTT ATGTTTTTTA ACGATAAATT CGGCGAGTTG

451  TCGGGTTTGG GCGCGTATGC GAAGGGCGTG TTGCTGTGTG CGGCAGGCAG

501  TATGGCATGG GTGTGTTATG CCGTGGCGCA AAAGCTGCTG TCGGCGCAAT

551  TCGGGCCGCA ACAGATTCTG CTGTTGATTT ATGCGGCAAG TGCCGCCGTG

601  TTCCTGCCGT TTGCCGAACT GGCACACATC GGAAGTTTGG ACGGTACGTT

651  GGCGTGGGTT TGTTTTGCGT ATTGCTGCTT GAATACGTTA ATCGGTTACG

701  GCTCGTTCGG CGAGGCGTTG AAACATTGGG AGGCTTCCAA AGTCAGCGCG

751  GTAACAACCT TGCTCCCCGT GTTTACCGTA ATATTTTCTT TGCTCGGGCA

801  TTATGTGATG CCTGATACTT TTGCCGCGCC GGATATGAAC GGTTTGGGTT

851  ATGCCGGCGC ACTGGTCGTG GTCGGGGGTG CGGTTACGGC GGCGGTGGGG

901  GACAGGCTGT TCAAACGCCG CTAG
```

This encodes a protein having amino acid sequence <SEQ ID 404>:

```
  1 MENQRPLLGF ALALLAAMTW GTLPIAVRQV LKFVDAPTLV WVRFTVAAAV

51 LFVLLALGGR LPKWRDFSWC SFRLLLLGVA GISANFVLIA QGLHYISPTT

101 TQVLWQISPF TMIVVGVLVF KDRMTAAQKI GLVLLLAGLL MFFNDKFGEL

151 SGLGAYAKGV LLCAAGSMAW VCYAVAQKLL SAQFGPQQIL LLIYAASAAV

201 FLPFAELAHI GSLDGTLAWV CFAYCCLNTL IGYGSFGEAL KHWEASKVSA

251 VTTLLPVFTV IFSLLGHYVM PDTFAAPDMN GLGYAGALVV VGGAVTAAVG

301 DRLFKRR*
```

ORF104a and ORF104-1 show 98.2% identity in 277 aa overlap:

```
                  10         20         30         40         50         60
orf104a.pep   MENQRPLLGFALALLAAMTWGTLPIAVRQVLKFVDAPTLVWVRFTVAAAVLFVLLALGGR
              ||||||||||||||||||||||||||||||||||||||||||||||||||||||||||||
orf104-1      MENQRPLLGFALALLAAMTWGTLPIAVRQVLKFVDAPTLVWVRFTVAAAVLFVLLALGGR
                  10         20         30         40         50         60

70         80         90        100        110        120
orf104a.pep   LPKWRDFSWCSFRLLLLGVAGISANFVLIAQGLHYISPTTTQVLWQISPFTMIVVGVLVF
              ||| ||||||||||||||||||||||||||||||||||||||||||||||||||||||||
orf104-1      LPKRRDFSWCSFRLLLLGVAGISANFVLIAQGLHYISPTTTQVLWQISPFTMIVVGVLVF
                  70         80         90        100        110        120

130        140        150        160        170        180
orf104a.pep   KDRMTAAQKIGLVLLLAGLLMFFNDKFGELSGLGAYAKGVLLCAAGSMAWVCYAVAQKLL
              ||||||||||||||||||||||||||||||||||||||||||||||||||||||||||||
orf104-1      KDRMTAAQKIGLVLLLAGLLMFFNDKFGELSGLGAYAKGVLLCAAGSMAWVCYAVAQKLL
                 130        140        150        160        170        180

190        200        210        220        230        240
orf104a.pep   SAQFGPQQILLLIYAASAAVFLPFAELAHIGSLDGTLAWVCFAYCCLNTLIGYGSFGEAL
              |||||||||||||||||||||||||| |||||||||||||||||||||||||||||||||
orf104-1      SAQFGPQQILLLIYAASAAVFLPFAEPAHIGSLDGTLAWVCFAYCCLNTLIGYGSFGEAL
                 190        200        210        220        230        240
```

```
                   250        260        270        280        290        300
orf104a.pep   KHWEASKVSAVTTLLPVFTVIFSLLGHYVMPDTFAAPDMNGLYAGALVVVGGAVTAAVG
              |||||||||||||||||||||||   |||||||| :|||||
orf104-1      KHWEASKVSAVTTLLPVFTVIXXLLGHYVMPETFAAP
                   250        260        270
```

Homology with a Predicted ORF from *N. gonorrhoeae*

ORF104 shows 93.9% identity over a 277aa overlap with a predicted ORF (ORF104.ng) from *N. gonorrhoeae*:

```
orf104.pep   MENQRPLLGFRLALLAAMTWGTLPXSVRQVLKFVDAPTLVWVRFTVAAAVLFVLLALGGR   60
             ||||||||| |||||||||||||| :||||||||||||||||||||||||||||||||||
orf104ng     MENQRPLLGFALALLAAMTWGTLPIAVRQVLKFVDAPTLVWVRFTVAAAVLFVLLALGGR   60
orf104.pep   LPKRRDFSWCSFRLLLLGVAGISANFVLIAQGLHYISPTTTQVLWQISPFTMIVVGVLVF  120
             |||||||||| |||||||| ||||||||||||||||||||||||||||||||||||||||
orf104ng     LPKRRDFSWHSFRLLLLGVTGISANFVLIAQGLHYISPTTTQVLWQISPFTMIVVGVLVF  120
orf104.pep   KDRMTAAQKIGLVLLLAGLLMYFNDKFGELSGLGAYXKGVLLCAAGSMAWVCNAVAQKLL  180
             ||||||||||||||| :|||| ||||||||||||||| |||||||||||||| |||||||
orf104ng     KDRMTAAQKIGLVLLLVGLLMFFNDKFGELSGLGAYAKGVLLCAAGSMAWVCYAVAQKLL  180
orf104.pep   SAQFGPQQILLLIYAASAAVFLPFAEPAHIGSMDGTLAWVCIAYCCLNTLIGYGSFGEAL  240
             ||||||||||||||||||||||  |||||||| :|||||||| : :|||||||||||||
orf104ng     SAQFGPQQILLLIYAASAAVFLLXAEPAHIGSLDGTLAWVCFVYCCLNTLIGYGSFGEAL  240
orf104.pep   KHWEASKVSAVTTLLPVFTVINTLLGHYVMPETFAAP                        277
             |||||||||||||||||||||  : ||||||||:||||
orf104ng     KHWEASKVSAVTTLLPVFTVIFSLLGHYVMPDTFAAPDMNGLYAGALVVVGGAVTAAVG  300
```

The complete length ORF104ng nucleotide sequence <SEQ ID 405> is predicted to encode a protein having amino acid sequence <SEQ ID 406>:

```
  1 MENQRPLLGF ALALLAAMTW GTLPIAVRQV LKFVDAPTLV WVRFTVAAAV

51 LFVLLALGGR LPKRRDFSWH SFRLLLLGVT GISANFVLIA QGLHYISPTT

101 TQVLWQISPF TMIVVGVLVF KDRMTAAQKI GLVLLLVGLL MFFNDKFGEL

151 SGLGAYAKGV LLCAAGSMAW VCYAVAQKLL SAQFGPQQIL LLIYAASAAV

201 FLLXAEPAHI GSLDGTLAWV CFVYCCLNTL IGYGSFGEAL KHWEASKVSA

251 VTTLLPVFTV IFSLLGHYVM PDTFAAPDMN GLGYVGALVV VGGAVTAAVG

301 DRPFKRR*
```

Further work revealed the complete gonococcal nucleotide sequence <SEQ ID 407>:

```
  1 ATGGAAAACC AAAGGCCGCT CCTAGGCTTC GCGTTGGCAC TTTTGGCGGC

51 GATGACGTGG GGGACGCTGC CGATTGCCGT GCGGCAGGTA TTGAAGTTTG

101 TCGATGCGCC GACGCTGGTG TGGGTGCGTT TTACCGTGGC GGCGGCGGTA

151 TTGTTTGTTT TGCTGGCATT GGGCGGGCGG CTGCCGAAGC GGCGGGATTT

201 TTCTTGGCAT TCATTCAGGC TGCTGCTGCT CGGCGTGACG GGCATTTCGG

251 CAAACTTTGT GCTGATTGCC AAGGGCTGC ATTATATTTC GCCGACCACG

301 ACGCAGGTTT TGTGGCAGAT TTCGCCGTTT ACGATGATTG TTGTCGGCGT

351 GTTGGTGTTT AAAGACCGGA tgaCTGCCGC GCAGAAAATC GGTTTGGTTT

401 TGCTGCttgT CGGTttgCTT ATGTTTTtta ACGACAAATT CGGCGAGTTG

451 TCGGGTTTGG GCGCGTATGC GAAGGGCGTG TTGCTGTGTG CGGCAGGCAG
```

```
-continued
501 TATGGCCTGG GTGTGTTATG CCGTGGCGCA AAAGCTGCTG TCGGCGCAAT

551 TCGGGCCGCA ACAGATTCTG CTGTTGATTT ATGCGGcaag tgccgccGTG

601 TTCCtgccgT TTGccgaaCC GGCACACATC GGAAGTTTgg aCGGTACGtt

651 GGCGTGGGTT TGTTTTGTGT ATTGCTGCTT GAATACGTTA ATCGGTTACG

701 GCTCGTTCGG CGAGGCGTTG AAACATTGGG AGGCTTCCAA AGTCAGCGCG

751 GTAACAACCT TGCTCCCCGT GTTTACCGTA ATATTTTCTT TGCTCGGGCA

801 TTATGTGATG CCTGATACTT TTGCCGCGCC GGATATGAAC GGTTTGGGTT

851 ATGTCGGCGC ACTGGTCGTG GTCGGGGGTG CGGTTACGGC GGCGGTGGGG

901 GACAGGCCGT TCAAACGCCG CTAG
```

This corresponds to the amino acid sequence <SEQ ID 408; ORF104ng-1>:

```
  1 MENQRPLLGF ALALLAAMTW GTLPIAVRQV LKFVDAPTLV WVRFTVAAAV

51 LFVLLALGGR LPKRRDFSWH SFRLLLLGVT GISANFVLIA QGLHYISPTT

101 TQVLWQISPF TMIVVGVLVF KDRMTAAQKI GLVLLLVGLL MFFNDKFGEL

151 SGLGAYAKGV LLCAAGSMAW VCYAVAQKLL SAQFGPQQIL LLIYAASAAV

201 FLPFAEPAHI GSLDGTLAWV CFVYCCLNTL IGYGSFGEAL KHWEASKVSA

251 VTTLLPVFTV IFSLLGHYVM PDTFAAPDMN GLGYVGALVV VGGAVTAAVG

301 DRPFKRR*
```

ORF104ng-1 and ORF104-1 show 97.5% identity in 277 aa overlap:

```
                    10         20         30         40         50         60
orf104-1.pep  MENQRPLLGFALALLAAMTWGTLPIAVRQVLKFVDAPTLVWVRFTVAAAVLFVLLALGGR
              ||||||||||||||||||||||||||||||||||||||||||||||||||||||||||||
orf104ng-1    MENQRPLLGFALALLAAMTWGTLPIAVRQVLKFVDAPTLVWVRFTVAAAVLFVLLALGGR
                    10         20         30         40         50         60

70         80         90        100        110        120
orf104-1.pep  LPKRRDFSWCSFRLLLLGVAGISANFVLIAQGLHYISPTTTQVLWQISPFTMIVVGVLVF
              |||||||||| ||||||||| |||||||||||||||||||||||||||||||||||||||
orf104ng-1    LPKRRDFSWHSFRLLLLGVTGISANFVLIAQGLHYISPTTTQVLWQISPFTMIVVGVLVF
                    70         80         90        100        110        120

130        140        150        160        170        180
orf104-1.pep  KDRMTAAQKIGLVLLLAGLLMFFNDKFGELSGLGAYAKGVLLCAAGSMAWVCYAVAQKLL
              ||||||||||||||||| ||||||||||||||||||||||||||||||||||||||||||
orf104ng-1    KDRMTAAQKIGLVLLLVGLLMFFNDKFGELSGLGAYAKGVLLCAAGSMAWVCYAVAQKLL
                   130        140        150        160        170        180

190        200        210        220        230        240
orf104-1.pep  SAQFGPQQILLLIYAASAAVFLPFAEPAHIGSLDGTLAWVCFAYCCLNTLIGYGSFGEAL
              |||||||||||||||||||||||||||||||||||||||||| :|||||||||||||||
orf104ng-1    SAQFGPQQILLLIYAASAAVFLPFAEPAHIGSLDGTLAWVCFVYCCLNTLIGYGSFGEAL
                   190        200        210        220        230        240

250        260        270
orf104-1.pep  KHWEASKVSAVTTLLPVFTVIXXLLGHYVMPETFAAP
              |||||||||||||||||||| |||||||||: ||||
orf104ng-1    KHWEASKVSAVTTLLPVFTVIFSLLGHYVMPDTFAAPDMNGLGYVGALVVVGGAVTAAVG
                   250        260        270        280        290        300
```

In addition, ORF104ng-1 shows significant homology with a hypothetical H. influenzae protein:

```
gi|1573895 (U32769) hypothetical [Haemophilus influenzae] Length = 306
 Score = 237 bits (598), Expect = 8e-62
```

-continued

```
Identities = 114/280 (40%), Positives = 168/280 (59%),
Gaps = 8/280 (2%)

Query:  30  QRPXXXXXXXXXXXMTWGTLPIAVRQVLKFVDAPTLVWXXXXXXXXXXXXXXXXXXXXXP-  88
                Q+P         M WG+LPIA++QVL   ++A T+VW                     P
Sbjct:   3  QQPLLGFTFALITAMAWGSLPIALKQVLSVMNAQTIVWYRFIIAAVSLLALLAYKKQLPE   62

Query:  89  --KRRDFSWHSFRLLLLGVTGISANFVLIAQGLHYISPTTTQVLWQISPFTMIVVGVLVF  146
              K R ++W       ++L+GV G+++NF+L +   L+YI P+    Q+     +S F M++ GVL+F
Sbjct:  63  LMKVRQYAW----IMLIGVIGLTSNFLLFSSSLNYIEPSVAQIFIHLSSFGMLICGVLIF  118

Query: 147  KDRMTAAQKIXXXXXXXXXXXMFFNDKFGELSGLGAYAKGVLLCAAGSMAWVCYAVAQKLL  206
                K+++    QKI            +FFND+F   +GL  Y+ GV+L    G++ WV Y +AQKL+
Sbjct: 119  KEKLGLHQKIGLFLLLIGLGLFFNDRFDAFAGLNQYSTGVILGVGGALIWVAYGMAQKLM  178

Query: 207  SAQFGPQQILLLIYAASAAVFLPFAEPAHIGSLDGTLAWVCFVYCCLNTLIGYGSFGEAL  266
                 +F  QQILL++Y   A   F+P A+ + +    L   LA +CF+YCCLNTLIGYGS+ EAL
Sbjct: 179  LRKFNSQQILLMMYLGCAIAFMPMADFSQVQELT-PLALICFIYCCLNTLIGYGSYAEAL  237

Query: 267  KHWEASKVSAVTTLLPVFTVIFSLLGHYVMPDTFAAPDMN                      306
                W+  SKVS V TL+P+FT++FS + HY  P    FAAP++N
Sbjct: 238  NRWDVSKVSVVITLVPLFTILFSHIAHYFSPADFAAPELN                      277
```

Based on this analysis, including the presence of a putative leader sequence and several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 48

The following partial DNA sequence was identified in *N. meningitidis* <SEQ ID 409>:

```
  1 ATGGTAGCTC GTCGGGCTCA TAACCCGAAG GTCGTAGGTT CGAATCCTGT
 51 .CCCGCAACC TAATTTCAAA CCCCTCGGTT CAATGCCGAG GG.GTTTTGT
101 T.TTGCCTGT TTCCTGTTTC CTGTTTCCTG CCGCCTCCGT TTTTTGCCGG
151 ATTTTCCTTC CGGCCGCAAT ATCGGAACGG CAGACCGCCG TCTGTTTGCG
201 GTTGCAAATT CAGGCAGTTT GGCTACAATC TTCCGCATTG TCTTCAAGAA
251 AGCCAACCAT GCCGACCGTC CGTTTTACCG AATCCGTCAG CAAACAAGAC
301 CTTGATGCTC TGTTCGAGTG GGCAAAAGCA AGTTACGGTG CAGAAAGTTG
351 CTGGAAAACG CTGTATCTGA ACGGTCysCC TTTGGGCAAC CTGTCGCCGG
401 AATGGGTGGA ACGCGTsmmA AAAGACTGGG AGGCAGGCTG CyCGGAGTCT
451 TCAGACGGCA TTTTTCTGAA TgCGGACGGc TGgCctGATA TGGgCGGAcg
501 cTTACAGCAC CTCGCCCTCG GTTGGCACTG TGCGGGGCTG TTGGACGgsT
551 GGCGCAACGA GTGTTTCGAC CTGACCGACG GCGGCGGCAA CCCCTTGTTC
601 ACGCTCGaAc GCGCCGyTTT mCGTCCTkTC GGACTGCTCA GCCGCGCCGT
651 CCATCTCAAC GGTCTGACCG AATCGGACGG CCGATGGCAT TTCTGGATAG
701 GCAGGCGCAG TCCGCACAAA GCAGTCGATC CCAACAAACT CGACAATACT
751 rCCGCCGGCG GTGTTTCCGG CGGCGAAATG CCGTCTGAAG CCGTGTGTCG
801 CGAAAGCAGC GAAGAAGCCG GTTTGGATAA AACGCTGcTT CCGCTCATCC
851 GCCCGGTATC GCAGCTGCAC AGCCTGCGCT CCGTCAGCCG GGGTGTACAC
901 AATGAAATCC TGTATGTATT CGATGCCGTC CTGCCG...
```

This corresponds to the amino acid sequence <SEQ ID 410; ORF105>:

```
  1 MVARRAHNPK VVGSNPXPAT XFQTPRFNAE XVLXLPVSCF LFPAASVFCR

51 IFLPAAISER QTAVCLRLQI QAVWLQSSAL SSRKPTMPTV RFTESVSKQD

101 LDALFEWAKA SYGAESCWKT LYLNGXPLGN LSPEWVERVX KDWEAGCXES

151 SDGIFLNADG WPDMGGRLQH LALGWHCAGL LDGWRNECFD LTDGGGNPLF

201 TLERAXXRPX GLLSRAVHLN GLTESDGRWH FWIGRRSPHK AVDPNKLDNT

251 XAGGVSGGEM PSEAVCRESS EEAGLDKTLL PLIRPVSQLH SLRSVSRGVH

301 NEILYVFDAV LP...
```

Further work revealed the complete nucleotide sequence <SEQ ID 411>:

```
  1 ATGCCGACCG TCCGTTTTAC CGAATCCGTC AGCAAACAAG ACCTTGATGC

51 TCTGTTCGAG TGGGCAAAAG CAAGTTACGG TGCAGAAAGT TGCTGGAAAA

101 CGCTGTATCT GAACGGTCTG CCTTTGGGCA ACCTGTCGCC GGAATGGGTG

151 GAACGCGTCA AAAAGACTGG GAGGCAGGC TGCTCGGAGT CTTCAGACGG

201 CATTTTTCTG AATGCGGACG GCTGGCCTGA TATGGGCGGA CGCTTACAGC

251 ACCTCGCCCT CGGTTGGCAC TGTGCGGGGC TGTTGGACGG CTGGCGCAAC

301 GAGTGTTTCG ACCTGACCGA CGGCGGCGGC AACCCCTTGT TCACGCTCGA

351 ACGCGCCGCT TTCCGTCCTT TCGGACTGCT CAGCCGCGCC GTCCATCTCA

401 ACGGTCTGAC CGAATCGGAC GGCCGATGGC ATTTCTGGAT AGGCAGGCGC

451 AGTCCGCACA AAGCAGTCGA TCCCAACAAA CTCGACAATA CTGCCGCCGG

501 CGGTGTTTCC GGCGGCGAAA TGCCGTCTGA AGCCGTGTGT CGCGAAAGCA

551 GCGAAGAAGC CGGTTTGGAT AAAACGCTGC TTCCGCTCAT CCGCCCGGTA

601 TCGCAGCTGC ACAGCCTGCG CTCCGTCAGC CGGGGTGTAC ACAATGAAAT

651 CCTGTATGTA TTCGATGCCG TCCTGCCCGA AACCTTCCTG CCTGAAAATC

701 AGGATGGCGA AGTGGCGGGT TTTGAGAAAA TGGACATCGG CGGTCTGTTG

751 GATGCCATGT TGTCGGGAAA CATGATGCAC GACGCGCAAC TGGTTACGCT

801 GGACGCGTTT TGCCGTTACG GTCTGATTGA TGCCGCCCAT CCGCTGTCCG

851 AGTGGCTGGA CGGCATACGT TTATAG
```

This corresponds to the amino acid sequence <SEQ ID 412; ORF105-1>:

```
  1 MPTVRFTESV SKQDLDALFE WAKASYGAES CWKTLYLNGL PLGNLSPEWV

51 ERVKKDWEAG CSESSDGIFL NADGWPDMGG RLQHLALGWH CAGLLDGWRN

101 ECFDLTDGGG NPLFTLERAA FRPFGLLSRA VHLNGLTESD GRWHFWIGRR

151 SPHKAVDPNK LDNTAAGGVS GGEMPSEAVC RESSEEAGLD KTLLPLIRPV

201 SQLHSLRSVS RGVHNEILYV FDAVLPETFL PENQDGEVAG FEKMDIGGLL

251 DAMLSGNMMH DAQLVTLDAF CRYGLIDAAH PLSEWLDGIR L*
```

Computer analysis of this amino acid sequence gave the following results:

Homology with a Predicted ORF from *N. meningitidis* (Strain A)

ORF105 shows 89.4% identity over a 226aa overlap with an ORF (ORF105a) from strain A of *N. meningitidis*:

```
                    60         70         80         90        100        110
orf105.pep  ISERQTAVCLRLQIQAVWLQSSALSSRKPTMPTVRFTESVSKQDLDALFEWAKASYGAES
                                       ||||||||||||||| |||||||||||||||||
orf105a                                MPTVRFTESVSKHDLDALFEWAKASYGAES
                                       10         20         30
                   120        130        140        150        160        170
orf105.pep  CWKTLYLNGXPLGNLSPEWVERVXKDWEAGCXESSDGIFLNADGWPDMGGRLQHLALGWH
            |||||||||| |||||||||| |||||||| |||||||||||||||||| |||||| |
orf105a     CWKTLYLNGLPLGNLSPEWAERVKKDWEAGCSESSDGIFLNADGWPDMGRRLQHLARIWK
                       40         50         60         70         80         90
                   180        190        200        210        220        230
orf105.pep  CAGLLDGWRNECFDLTDGGGNPLFTLERAXXRPXGLLSRAVHLNGLTESDGRWHFWIGRR
             ||| ||||| |||||||||| |||| |||| || ||||||||||||| |||||||||||
orf105a     EAGLLHGWRDECFDLTDGGSNPLFALERAAFRPFGLLSRAVHLNGLVESDGRWHFWIGRR
                       100        110        120        130        140        150
                   240        250        260        270        280        290
orf105.pep  SPHKAVDPNKLDNTXAGGVSGGEMPSEAVCRESSEEAGLDKTLLPLIRPVSQLHSLRSVS
            |||||||| ||||| |||||| || | || ||||||||||||||||||||||||| |||
orf105a     SPHKAVDPDKLDNTAAGGVSSGELPSETVCRESSEEAGLDKTLLPLIRPVSQLHSLRPVS
                       160        170        180        190        200        210
                   300        310
orf105.pep  RGVHNEILYVFDAVLP
            ||||||||||||||||
orf105a     RGVHNEILYVFDAVLPETFLPENQDGEVAGFEKMDIGGLLAAMLSGNMMHDAQLVTLDAF
                       220        230        240        250        260        270
```

The complete length ORF105a nucleotide sequence <SEQ ID 413> is:

```
  1 ATGCCGACCG TCCGTTTTAC CGAATCCGTC AGCAAACACG ACCTTGATGC

51 CCTATTCGAG TGGGCAAAGG CAAGTTACGG TGCGGAAAGT TGCTGGAAAA

101 CGCTGTATCT GAACGGTCTG CCTTTGGGCA ATCTGTCGCC GGAATGGGCG

151 GAGCGCGTCA AAAAGACTG GGAGGCAGGC TGCTCGGAGT CTTCAGACGG

201 CATTTTCCTG AATGCGGACG GCTGGCCAGA TATGGGCAGA CGCTTGCAGC

251 ACCTCGCCCG AATATGGAAA GAAGCGGGAC TGCTTCACGG CTGGCGCGAC

301 GAGTGTTTCG ACCTGACCGA CGGCGGCAGC AATCCCTTGT TCGCGCTCGA

351 ACGCGCCGCT TTCCGTCCGT TCGGACTGCT CAGCCGCGCC GTCCATCTCA

401 ACGGTTTGGT CGAATCGGAC GGCCGATGGC ATTTCTGGAT AGGCAGGCGC

451 AGTCCGCACA AAGCAGTCGA TCCCGACAAA CTCGACAATA CTGCCGCCGG

501 CGGTGTTTCC AGCGGTGAAT TGCCGTCTGA AACCGTGTGT CGCGAAAGCA

551 GCGAAGAAGC CGGTTTGGAT AAAACGCTGC TTCCGCTCAT CCGCCCGGTA

601 TCGCAGCTGC ACAGCCTGCG CCCCGTCAGC CGGGGTGTGC ACAATGAAAT

651 CCTGTATGTA TTCGATGCCG TCCTGCCCGA AACCTTCCTG CCTGAAAATC

701 AGGATGGCGA AGTGGCGGGT TTTGAGAAAA TGGACATCGG CGGTCTGTTG

751 GCTGCCATGT TGTCGGGAAA CATGATGCAC GACGCGCAAC TGGTTACGCT

801 GGACGCGTTT TGCCGTTACG GTCTGATTGA TGCCGCCCAT CCGCTGTCCG

851 AGTGGCTGGA CGGCATACGT TTATAG
```

This encodes a protein having amino acid sequence <SEQ ID 414>:

```
  1 MPTVRFTESV SKHDLDALFE WAKASYGAES CWKTLYLNGL PLGNLSPEWA

51 ERVKKDWEAG CSESSDGIFL NADGWPDMGR RLQHLARIWK EAGLLHGWRD

101 ECFDLTDGGS NPLFALERAA FRPFGLLSRA VHLNGLVESD GRWHFWIGRR

151 SPHKAVDPDK LDNTAAGGVS SGELPSETVC RESSEEAGLD KTLLPLIRPV

201 SQLHSLRPVS RGVHNEILYV FDAVLPETFL PENQDGEVAG FEKMDIGGLL

251 AAMLSGNMMH DAQLVTLDAF CRYGLIDAAH PLSEWLDGIR L*
```

ORF105a and ORF105-1 show 93.8% identity in 291 aa overlap:

```
                       10         20         30         40         50         60
orf105a.pep    MPTVRFTESVSKHDLDALFEWAKASYGAESCWKTLYLNGLPLGNLSPEWAERVKKDWEAG
               ||||||||||:|||||||||||||||||||||||||||||||||||||||:|||||||||
orf105-1       MPTVRFTESVSKQDLDALFEWAKASYGAESCWKTLYLNGLPLGNLSPEWVERVKKDWEAG
                       10         20         30         40         50         60
                       70         80         90        100        110        120
orf105a.pep    CSESSDGIFLNADGWPDMGRRLQHLARIWKEAGLLHGWRDECFDLTDGGSNPLFALERAA
               |||||||||||||||||||||:||||| ||:||||:|||||||||||||:|||:|||||
orf105-1       CSESSDGIFLNADGWPDMGGRLQHLALGWHCAGLLDGWRNECFDLTDGGGNPLFTLERAA
                       70         80         90        100        110        120
                      130        140        150        160        170        180
orf105a.pep    FRPFGLLSRAVHLNGLVESDGRWHFWIGRRSPHKAVDPDKLDNTAAGGVSSGELPSETVC
               ||||||||||||||||:|||||||||||||||||||:||||||||||||:|:|::|:||
orf105-1       FRPFGLLSRAVHLNGLTESDGRWHFWIGRRSPHKAVDPNKLDNTAAGGVSGGEMPSEAVC
                      130        140        150        160        170        180
                      190        200        210        220        230        240
orf105a.pep    RESSEEAGLDKTLLPLIRPVSQLHSLRPVSRGVHNEILYVFDAVLPETFLPENQDGEVAG
               |||||||||||||||||||||||||||:||||||||||||||||||||||||||||||||
orf105-1       RESSEEAGLDKTLLPLIRPVSQLHSLRSVSRGVHNEILYVFDAVLPETFLPENQDGEVAG
                      190        200        210        220        230        240
                      250        260        270        280        290
orf105a.pep    FEKMDIGGLLAAMLSGNMMHDAQLVTLDAFCRYGLIDAAHPLSEWLDGIRLX
               ||||||||||:|||||||||||||||||||||||||||||||||||||||||
orf105-1       FEKMDIGGLLDAMLSGNMMHDAQLVTLDAFCRYGLIDAAHPLSEWLDGIRLX
                      250        260        270        280        290
```

Homology with a Predicted ORF from *N. gonorrhoeae*

ORF105 shows 87.5% identity over a 312aa overlap with a predicted ORF (ORF105.ng) from *N. gonorrhoeae*:

```
orf105.pep    MVARRAHNPKVVGSNPXPATXFQTPRFNAEXVLXLPVSCFLFPAASVFCRIFLPAAISER    60
              |||||||||||||||| ||| :|||||||| ||       ||||||||||||||||||||
orf105ng      MVARRAHNPKVVGSNPAPATKYQTPRFNAEGVLF-----FLFPAASVFCRIFLPAAISER    55 orf105.pep    QTAVCLRLQIQAVWLQSSALSSRKPTMPTVRFTESVSKQDLDALFEWAKASYGAESCWKT   120
              |:|||||||||||||||||| |||| ||||||||||||||||||||| |||||||||||
orf105ng      QAAVCLRLQIQAVWLQSSALCSRKPAMPTVRFTESVSKQDLDALFERAKASYGAESCWKT   115 orf105.pep    LYLNGXPLGNLSPEWVERVXKDWEAGCXESSDGIFLNADGWPDMGGRLQHLALGWHCAGL   180
              ||||  |||||||||||  :||||||| ||||:|:|||||||||||||||||||||||||     |: |||
orf105ng      LYLNRLPLGNLSPEWAERIKKDWEAGCSESSNGIFLNADGWPDMGGRLQHLARTWNKAGL   175 orf105.pep    LDGWRNECFDLTDGGGNPLFTLERAXXRPXGLLSRAVHLNGLTESDGRWHFWIGRRSPHK   240
              | |||||||||||||||||||||||  ||:|||||||||||||:|||||||||||||||
orf105ng      LHGWRNECFDLTDGGGNPLFTLERAAFRPFGLLIRAVHLNGLVESNGRWHFWIGRRSPHK   235 orf105.pep    AVDPNKLDNTXAGGVSGGEMPSEAVCRESSEEAGLDKTLLPLIRPVSQLHSLRSVSRGVH   300
              ||||:||||  ||||||||||||||||||||||||||:|||||||||:|||||:||||||
orf105ng      AVDPGKLDNIAGGGVSGGEMPSEAVCRESSEEAGLDKTLFPLIRPVSRLHSLRPVSRGVH   295 orf105.pep    NEILYVFDAVLP                                                 312
              ||||||||||||
orf105ng      NEILYVFDAVLPETFLPENQDGEVAGFEKMDIGGLLDAMLSKNMMHDAQLVTLDAFYRYG   355
```

A complete length ORF105ng nucleotide sequence <SEQ ID 415> was predicted to encode a protein having amino acid sequence <SEQ ID 416>:

```
  1 MVARRAHNPK VVGSNPAPAT KYQTPRFNAE GVLFFLFPAA SVFCRIFLPA

51 AISERQAAVC LRLQIQAVWL QSSALCSRKP AMPTVRFTES VSKQDLDALF

101 ERAKASYGAE SCWKTLYLNR LPLGNLSPEW AERIKKDWEA GCSESSNGIF

151 LNADGWPDMG GRLQHLARTW NKAGLLHGWR NECFDLTDGG GNPLFTLERA

201 AFRPFGLLIR AVHLNGLVES NGRWHFWIGR RSPHKAVDPG KLDNIAGGGV

251 SGGEMPSEAV CRESSEEAGL DKTLFPLIRP VSRLHSLRPV SRGVHNEILY

301 VFDAVLPETF LPENQDGEVA GFEKMDIGGL LDAMLSKNMM HDAQLVTLDA

351 FYRYGLIDAA HPLSEWLDGI RL*
```

Further work revealed the complete nucleotide sequence <SEQ ID 417>:

```
  1 ATGCCGACCG TCCGTTTTAC CGAATCCGTC AGCAAACAAG ACCTTGATGC

51 CCTGTTCGAG CGGGCAAAAG CAAGTTACGG TGCCGAAAGT TGCTGGAAAA

101 CGCTGTATCT GAACCGTCTT CCTTTGGGCA ATCTGTCGCC GGAATGGGCT

151 GAGCGCATCA AAAAGACTG GGAGGCAGGC TGCTCCGAGT CTTCAGACGG

201 CATTTTTCTG AATGCGGACG GCTGGCCGGA TATGGGCGGA CGCTTGCAGC

251 ACCTCGCCCG CACATGGAAC AAGGCGGGGC TGCTTCACGG ATGGCGCAAC

301 GAGTGTTTCG ACCTGACCGA CGGCGGCGGC AACCCCTTGT TCACGCTCGA

351 ACGCGCCGCT TTCCGTCCGT TCGGACTACT CAGCCGCGCC GTCCATCTCA

401 ACGGTTTGGT CGAATCGAAC GGCAGATGGC ATTTTTGGAT AGGCAGGCGC

451 AGTCCGCACA AAGCAGTCGa tcCCGGCAAG CTCGACAATA TTGCCGGCGG

501 CGGTGTTTCC GGCGGCGAAA TGCCGTCTGA AGCCGTGTGC CGCGAAAGCA

551 GCGAAGAAGC CGGTTTGGAT AAAACGCTGT TTCCGCTCAT CCGCCCAGTA

601 TCGCGGCTGC ACAGCCTTCG CCCCGTCAGC CGAGGTGTGC ACAATGAAAT

651 CCTGTATGTG TTCGATGCCG TCCTGCCCGA AACCTTCCTG CCTGAAAATC

701 AGGATGGCGA GGTAGCGGGT TTTGAAAAGA TGGACATTGG CGGCCTATTG

751 GATGCCATGT TGTCGAAAAA CATGATGCAC GACGCGCAAC TGGTTACGCT

801 GGACGCGTTT TACCGTTACG GTCTGATTGA TGCCGCCCAT CCGCTGTCCG

851 AGTGGCTGGA CGGCATACGT TTATAG
```

This corresponds to the amino acid sequence <SEQ ID 418; ORF105ng-1>:

```
  1 MPTVRFTESV SKQDLDALFE RAKASYGAES CWKTLYLNRL PLGNLSPEWA

51 ERIKKDWEAG CSESSDGIFL NADGWPDMGG RLQHLARTWN KAGLLHGWRN

101 ECFDLTDGGG NPLFTLERAA FRPFGLLSRA VHLNGLVESN GRWHFWIGRR

151 SPHKAVDPGK LDNIAGGGVS GGEMPSEAVC RESSEEAGLD KTLFPLIRPV

201 SRLHSLRPVS RGVHNEILYV FDAVLPETFL PENQDGEVAG FEKMDIGGLL

251 DAMLSKNMMH DAQLVTLDAF YRYGLIDAAH PLSEWLDGIR L*
```

ORG105ng-1 and ORF105-1 show 93.5% identity in 291 aa overlap:

```
                     10         20         30         40         50         60
orf105-1.pep    MPTVRFTESVSKQDLDALFEWAKASYGAESCWKTLYLNGLPLGNLSPEWVERVKKDWEAG
                |||||||||||||||||||| ||||||||||||||||| ||||||||||:||:|||||||
orf105ng-1      MPTVRFTESVSKQDLDALFERAKASYGAESCWKTLYLNRLPLGNLSPEWAERIKKDWEAG
                     10         20         30         40         50         60

70         80         90        100        110        120
orf105-1.pep    CSESSDGIFLNADGWPDMGGRLQHLALGWHCAGLLDGWRNECFDLTDGGGNPLFTLERAA
                ||||||||||||||||||||||||||||  :  ||||  |||||||||||||||||||||
orf105ng-1      CSESSDGIFLNADGWPDMGGRLQHLARTWNKAGLLHGWRNECFDLTDGGGNPLFTLERAA
                     70         80         90        100        110        120

130        140        150        160        170        180
orf105-1.pep    FRPFGLLSRAVHLNGLTESDGRWHFWIGRRSPHKAVDPNKLDNTAAGGVSGGEMPSEAVC
                |||||||||||||||||:|||||||||||||||||||||||| ||||:||||||||||||
orf105ng-1      FRPFGLLSRAVHLNGLVESNGRWHFWIGRRSPHKAVDPGKLDNIAGGGVSGGEMPSEAVC
                    130        140        150        160        170        180

190        200        210        220        230        240
orf105-1.pep    RESSEEAGLDKTLLPLIRPVSQLHSLRSVSRGVHNEILYVFDAVLPETFLPENQDGEVAG
                |||||||||||| :||||||||| :|||||||||||||||||||||||||||||||||||
orf105ng-1      RESSEEAGLDKTLFPLIRPVSRLHSLRPVSRGVHNEILYVFDAVLPETFLPENQDGEVAG
                    190        200        210        220        230        240

250        260        270        280        290
orf105-1.pep    FEKMDIGGLLDAMLSGNMMHDAQLVTLDAFCRYGLIDAAHPLSEWLDGIRLX
                |||||||||||||| |||||||||||||||| ||||||||||||||||||||
orf105ng-1      FEKMDIGGLLDAMLSKNMMHDAQLVTLDAFYRYGLIDAAHPLSEWLDGIRLX
                    250        260        270        280        290
```

Furthermore, ORF105ng-1 shows homology with a yeast enzyme:

```
sp|P41888|TNR3_SCHPO THIAMIN PYROPHOSPHOKINASE (TPK) (THIAMIN KINASE)
>gi|1076928|pir||S52350 thiamin pyrophosphokinase (EC 2.7.6.2) - fission yeast
(Schizosaccharomyces pombe) >gi|666111 (X84417) thiamin pyrophosphokinase
[Schizosaccharomyces pombe] >gi|2330852|gnl|PID|e334056 (Z98533) thiamin
pyrophosphokinase [Schizosaccharomyces pombe] Length = 569
Score = 105 bits (259) , Expect = 4e22
Identities = 64/192 (33%), Positives = 94/192 (48%), Gaps = 3/192 (1%)

Query:  268 NKAGLLHGWRNECFDLTDGGGNPLFTLERAAFRPFGLLSRAVHLNGLVESNGRW--HFWI   441
            N  G+   WRNE + +        P+ +ER F FG LS VH    + +      W+
Sbjct:   96 NTFGIADQWRNELYTVYGKSKKPVLAVERGGFWLFGFLSTGVHCTMYIPATKEHPLRIWV   155

Query:  442 GRRSPHKAVDPGKLDNIAGGGVSGGEMPSEAVCRESSEEAGLDKTLFPLIRPVSRLHSLR   621
            RRSP K   P  LDN   GG++ G+       + +E SEEA LD +    LI P   + ++
Sbjct:  156 PRRSPTKQTWPNYLDNSVAGGIAHGDSVIGTMIKEFSEEANLDVSSMNLI-PCGTVSYIK   214

Query:  622 PVSRG-VHNEILYVFDAVLPETFLPENQDGEVAGFEKMDIGGLLDAMLSKNMMHDAQLVT   798
             R   + E+ YVFD + + +P  DGEVAGF + +L   K+   + LV
Sbjct:  215 MEKRHWIQPELQYVFDLPVDDLVIPRINDGEVAGFSLLPLNQVLHELELKSFKPNCALVL   274

Query:  799 LDAFYRYGLIDAAHP   843
            LD   R+G+I  HP
Sbjct:  275 LDFLIRHGIITPQHP   289
```

Based on this analysis, including the presence of a putative transmembrane domain in the gonococcal protein, it is predicted that the proteins from *N. meningitidis* and *N. gonorrhoeae*, and their epitopes, could be useful antigens for vaccines or diagnostics, or for raising antibodies.

Example 49

The following DNA sequence, believed to be complete, was identified in *N. meningitidis* <SEQ ID 419>:

```
  1 ATGAATAGAC CAAGCAACC  CTTCTTCCGT CCCGAAGTCG CCGTTGCCCG
 51 CCAAACCAGC CTGACGGGTA AAGTGATTCT GACACGACCG TTGTCATTTT
```

```
101 CCCTATGGAC GACATTTGCA TCGATATCTG CGTTATTGAT TATCCTGTTT

151 TTGATATTTG GTAACTATAC GCGAAAGACA ACAGTGGAGG GACAAATTTT

201 ACCTGCATCG GGCGTAATCA GGGTGTATGC ACCGgATACG rGkACAATTA

251 CAGCGAAATT CGTGGAAGAT GGmsAAAAGG TTAAGGCTGG CGACAAGCTA

301 TTTGCGCTTT CGACCTCACG TTTCGGCGCA GGAGGTAGCG TGCAGCAGCA

351 GTTGAAAACG GAGGCAGTTT TGAAGAAAAC GTTGGCAGAA CAGGAACTGG

401 GTCGTCTGAA GCTGATACAC GGGAATGAAA CGCGCAgCcT TAAAGCAACT

451 GTCGAACGTT TGGAAAACCA GGAACTCCAT ATTTCGCAAC AGATAGACGG

501 TCAGAAAAGG CGCATTAGAC TTGCGGAAGA AATGTTGCAG AAATATCGTT

551 TCCTATCCGC .CAATGA
```

This corresponds to the amino acid sequence <SEQ ID 420; ORF107>:

```
  1 MNRPKQPFFR PEVAVARQTS LTGKVILTRP LSFSLWTTFA SISALLIILF

51 LIFGNYTRKT TVEGQILPAS GVIRVYAPDT XTITAKFVED GXKVKAGDKL

101 FALSTSRFGA GGSVQQQLKT EAVLKKTLAE QELGRLKLIH GNETRSLKAT

151 VERLENQELH ISQQIDGQKR RIRLAEEMLQ KYRFLSXQ*
```

Computer analysis of this amino acid sequence gave the following results:

Homology with a Predicted ORF from N. meningitidis (Strain A)

ORF107 shows 97.8% identity over a 186aa overlap with an ORF (ORF107a) from strain A of N. meningitidis:

```
                        10         20         30         40         50         60
        orf107.pep  MNRPKQPFFRPEVAVARQTSLTGKVILTRPLSFSLWTTFASISALLIILFLIFGNYTRKT
                    ||||||||||||||||||||||||||||||||||||||||||||||||||||||||||||
        orf107a     MNRPKQPFFRPEVAVARQTSLTGKVILTRPLSFSLWTTFASISALLIILFLIFGNYTRKT
                        10         20         30         40         50         60

70         80         90        100        110        120
        orf107.pep  TVEGQILPASGVIRVYAPDTXTITAKFVEDGXKVKAGDKLFALSTSRFGAGGSVQQQLKT
                    ||||||||||||||||||||| |||||||| ||||||||||||||||||| |||||||||
        orf107a     TVEGQILPASGVIRVYAPDTGTITAKFXEDGEKVKAGDKLFALSTSRFGAGDSVQQQLKT
                        70         80         90        100        110        120

130        140        150        160        170        180
        orf107.pep  EAVLKKTLAEQELGRLKLIHGNETRSLKATVERLENQELHISQQIDGQKRRIRLAEEMLQ
                    ||||||||||||||||||||||||||||||||||||||||||||||||||||||||||||
        orf107a     EAVLKKTLAEQELGRLKLIHGNETRSLKATVERLENQELHISQQIDGQKRRIRLAEEMLQ
                       130        140        150        160        170        180

189
        orf107.pep  KYRFLSXQX
                    ||||||
        orf107a     KYRFLSANDAVPKQEMMNVKAELLEQKAKLDAYRREEVGLLQEIRTQNLTLXSLPQAAX
                       190        200        210        220        230
```

The complete length ORF107a nucleotide sequence <SEQ ID 421> is:

```
  1 ATGAATAGAC CAAGCAACC NTTCTTCCGT CCCGAAGTCG CCGTTGCCCG

51 CCAAACCAGC CTGACGGGTA AAGTGATTCT GACACGACCG TTGTCATTTT
```

-continued

```
101 CCCTATGGAC GACATTTGCA TCGATATCTG CGTTATTGAT TATCCTGTTT
151 TTGATATTTG GTAACTATAC GCGAAAGACA ACAGTGGAGG GACAAATTTT
201 ACCTGCATCG GGCGTAATCA GGGTGTATGC ACCGGATACG GGGACAATTA
251 CNGCGAAATT CNTGGAAGAT GGAGAAAAGG TTAAGGCTGG CGACAAGCTA
301 TTTGCGCTTT CGACCTCACG TTTCGGCGCA GGAGATAGCG TGCAGCAGCA
351 GTTGAAAACG GAGGCAGTTT TGAAGAAAAC GTTGGCAGAA CAGGAACTGG
401 GTCGTCTGAA GCTGATACAC GGGAATGAAA CGCGCAGCCT TAAAGCAACT
451 GTCGAACGTT TGGAAAACCA GGAACTCCAT ATTTCGCAAC AGATAGACGG
501 TCAGAAAAGG CGCATTAGAC TTGCGGAAGA AATGTTGCAG AAATATCGTT
551 TCCTATCCGC CAATGATGCA GTGCCAAAAC AAGAAATGAT GAATGTCAAG
601 GCAGAGCTTT TAGAGCAGAA AGCCAAACTT GATGCCTACC GCCGAGAAGA
651 AGTCGGGCTG CTTCAGGAAA TCCGCACGCA GAATCTGACA TTGGNNAGCC
701 TCCCCCAAGC GGCATGA
```

This encodes a protein having amino acid sequence <SEQ ID 422>:

```
  1 MNRPKQPFFR PEVAVARQTS LTGKVILTRP LSFSLWTTFA SISALLIILF
 51 LIFGNYTRKT TVEGQILPAS GVIRVYAPDT GTITAKFXED GEKVKAGDKL
101 FALSTSRFGA GDSVQQQLKT EAVLKKTLAE QELGRLKLIH GNETRSLKAT
151 VERLENQELH ISQQIDGQKR RIRLAEEMLQ KYRFLSANDA VPKQEMMNVK
201 AELLEQKAKL DAYRREEVGL LQEIRTQNLT LXSLPQAA*
```

Homology with a Predicted ORF from *N. gonorrhoeae*

ORF107 shows 95.7% identity over a 188aa overlap with a predicted ORF (ORF107.ng) from *N. gonorrhoeae*:

```
orf107.pep    MNRPKQPFFRPEVAVARQTSLTGKVILTRPLSFSLWTTFASISALLIILFLIFGNYTRKT    60
              ||||||||||||||:|||||||||||||||||||||||||||||||||||||||||||||
orf107ng      MNRPKQPFFRPEVAIARQTSLTGKVILTRPLSFSLWTTFASISALLIILFLIFGNYTRKT    60 orf107.pep    TVEGQILPASGVIRVYAPDTXTITAKFVEDGXKVKAGDKLFALSTSRFGAGGSVQQQLKT   120
              |:||||||||||||||||||| |||||||||| |||||||||||||||||||||||||||
orf107ng      TMEGQILPASGVIRVYAPDTGTITAKFVEDGEKVKAGDKLFALSTSRFGAGGSVQQQLKT   120 orf107.pep    EAVLKKTLAEQELGRLKLIHGNETRSLKATVERLENQELHISQQIDGQKRRIRLAEEMLQ   180
              |||||||||||||||||||| |||||||||||||||||:|||||||||||||||||||:
orf107ng      EAVLKKTLAEQELGRLKLIHENETRSLKATVERLENQKLHISQQIDGQKRRIRLAEEMLR   180 orf107.pep    KYRFLSXQ    188
              ||||||  |
orf107ng      KYRFLSAQ    188
```

The complete length ORF107ng nucleotide sequence <SEQ ID 423> is predicted to encode a protein having amino acid sequence <SEQ ID 424>:

```
  1 MNRPKQPFFR PEVAIARQTS LTGKVILTRP LSFSLWTTFA SISALLIILF
 51 LIFGNYTRKT TMEGQILPAS GVIRVYAPDT GTITAKFVED GEKVKAGDKL
101 FALSTSRFGA GGSVQQQLKT EAVLKKTLAE QELGRLKLIH ENETRSLKAT
151 VERLENQKLH ISQQIDGQKR RIRLAEEMLR KYRFLSAQ*
```

Based on the presence of a putative ransmembrane domain in the gonococcal protein, it is predicted that the proteins from *N. meningitidis* and *N. gonorrhoeae*, and their epitopes, could be useful antigens for vaccines or diagnostics, or for raising antibodies.

Example 50

The following DNA sequence, believed to be complete, was identified in *N. meningitidis* <SEQ ID 425>:

```
  1 ATGCTGAATA CTTTTTTTGC CGTATTGGGC GGCTGCCTGC
    TGCT.TTGCC
 51 GTGCGGCAAA TCCGTAAATA CGGCGGTACA GCCGCAAAAC
    GCGGTACAAA
101 GCGCGCCGAA ACCGGTTTTC AAAGTCATAT ATATCGACAA
    TACGGCGATT
151 GCCGGTTTGG ATTTGGGACA AAGCAGCGAA GGCAAAACCA
    ACGACGGCAA
201 AAAACAAATC AGTTATCCGA TTAAAGGCTT GCCGGAACAA
    AATGTTATCC
251 GACTGATCGG CAAGCATCCC GGCGACTTGG AAGCCGTCAG
    CGGCAAATGT
301 ATGGAAACCG ATGATAAGGA CAGTCCGGCA GGTTGGGCAG
    AAAACGGCGT
351 GTGCCATACC TTGTTTGCCA AACTGGTGGG CAATATCGCC
    GAAGACGGCG
401 GCAAACTGAC GGATTACCTA GTTTCGCATG CCGCCCTGCA
    ACCCTATCAG
451 GCAGGCAAAA GCGGCTATGC CGCCGTGCAG AACGGACGCT
    ATGTGCTGGA
501 AATCGACAGC GAAGGGGCGT TTTATTTCCG CCGCCGCCAT
    TATTGA
```

This corresponds to the amino acid sequence <SEQ ID 426; ORF108>:

```
  1 MLNTFFAVLG GCLLXLPCGK SVNTAVQPQN AVQSAPKPVF
    KVIYIDNTAI
 51 AGLDLGQSSE GKTNDGKKQI SYPIKGLPEQ NVIRLIGKHP
    GDLEAVSGKC
101 METDDKDSPA GWAENGVCHT LFAKLVGNIA EDGGKLTDYL
    VSHAALQPYQ
151 AGKSGYAAVQ NGRYVLEIDS EGAFYFRRRH Y*
```

Further work revealed the following DNA sequence <SEQ ID 427>:

```
  1 ATGCTGAAAA CATCTTTTGC CGTATTGGGC GGCTGCCTGC
    TGCTTGCCGC
 51 CTGCGGCAAA TCCGAAAATA CGGCGGAACA GCCGCAAAAC
    GCGGTACAAA
101 GCGCGCCGAA ACCGGTTTTC AAAGTCAAAT ATATCGACAA
    TACGGCGATT
151 GCCGGTTTGG ATTTGGGACA AAGCAGCGAA GGCAAAACCA
    ACGACGGCAA
201 AAAACAAATC AGTTATCCGA TTAAAGGCTT GCCGGAACAA
    AATGTTATCC
251 GACTGATCGG CAAGCATCCC GGCGACTTGG AAGCCGTCAG
    CGGCAAATGT
301 ATGGAAACCG ATGATAAGGA CAGTCCGGCA GGTTGGGCAG
    AAAACGGCGT
351 GTGCCATACC TTGTTTGCCA AACTGGTGGG CAATATCGCC
    GAAGACGGCG
401 GCAAACTGAC GGATTACCTA GTTTCGCATG CCGCCCTGCA
    ACCCTATCAG
451 GCAGGCAAAA GCGGCTATGC CGCCGTGCAG AACGGACGCT
    ATGTGCTGGA
501 AATCGACAGC GAAGGGGCGT TTTATTTCCG CCGCCGCCAT
    TATTGA
```

This corresponds to the amino acid sequence <SEQ ID 428; ORF108-1>:

```
  1 MLKTSFAVLG GCLLLAACGK SENTAEQPQN AVQSAPKPVF
    KVKYIDNTAI
 51 AGLDLGQSSE GKTNDGKKQI SYPIKGLPEQ NVTRLIGKHP
    GDLEAVSGKC
101 METDDKDSPA GWAENGVCHT LFAKLVGNIA EDGGKLTDYL
    VSHAALQPYQ
151 AGKSGYAAVQ NGRYVLEIDS EGAFYFRRRH Y*
```

Computer analysis of this amino acid sequence gave the following results:

Homology with a Predicted ORF from *N. gonorrhoeae*

ORF108 shows 88.4% identity over a 181aa overlap with a predicted ORF (ORF108.ng) from *N. gonorrhoeae*:

```
orf108.pep  MLNTFFAVLGGCLLXLPCGKSVNTAVQPQNAVQSAPKPVFKVIYIDNTAIAGLDLGQSSE   60
            ||:||||||||||||  ||||||||||||:|||||||||||||:||||||||||||||
orf108ng    MLKIPFAVLGGCLLLAACGKSENTAEQPQNAAQSAPKPVFKVKYIDNTAIAGLALGQSSE   60 orf108.pep  GKTNDGKKQISYPIKGLPEQNVIRLIGKHPGDLEAVSGKCMETDDKDSPAGWAENGVCHT  120
            |||||||||||||||||||||::||||||||||||||||||||||||||||||||||||
orf108ng    GKTNDGKKQISYPIKGLPEQNAVRLTGKHPNDLEAVVGKCMETDGKDAPSGWAENGVCHT  120 orf108.pep  LFAKLVGNIAEDGGKLTDYLVSHAALQPYQAGKSGYAAVQNGRYVLEIDSEGAFYFRRRHY  181
            ||||||||||||||||||||:|||:|||||||||||||||||||||||||||||||||||
orf108ng    LFAKLVGNIAEDGGKLTDYLISHSALQPYQAGKSGYAAVQNGRYVLEIDSEGAFYFRRRHY  181
```

ORF108-1 shows 92.3% identity with ORF108ng over the same 181 aa overlap:

```
orf108-1.pep    MLKTSFAVLGGCLLLAACGKSENTAEQPQNAVQSAPKPVFKVKYIDNTAIAGLDLGQSSE    60
                ||| ||||||||||||||||||||||||||| ::|||||||||||||||||||| ||||||
orf108ng-1      MLKIPFAVLGGCLLLAACGKSENTAEQPQNAAQSAPKPVFKVKYIDNTAIAGLALGQSSE    60
orf108-1.pep    GKTNDGKKQISYPIKGLPEQNVIRLIGKHPGDLEAVSGKCMETDDKDSPAGWAENGVCHT   120
                ||||||||||||||||||||| ::|| |||| :||||| ||||||| || : ||||||||
orf108ng-1      GKTNDGKKQISYPIKGLPEQNAVRLTGKHPNDLEAVVGKCMETDGKDAPSGWAENGVCHT   120
orf108-1.pep    LFAKLVGNIAEDGGKLTDYLVSHAALQPYQAGKSGYAAVQNGRYVLEIDSEGAFYFRRRHY   181
                |||||||||||||||||||| :||:||||||||||||||||||||||||||||||||||||
orf108ng-1      LFAKLVGNIAEDGGKLTDYLISHSALQPYQAGKSGYAAVQNGRYVLEIDSEGAFYFRRRHY   181
```

The complete length ORF108ng nucleotide sequence <SEQ ID 429> is:

```
  1 ATGCTGAAAa tacctTTTGC CGTGTtgggc ggCtgcctGC
    TGCTTGCCGC

51 CTGCGGCAAA TCCGAAAATa cggcggaACA GCCGCAAAAT
    gcggCACAAA

101 GCGCGCCGAA ACCGGTTTTC AAAGTCAAAT ACATCGACAA
    TACGGCGATT

151 GCCGGTTTGG CTTTGGGACA AGTAGCGAA GGCAAAACCA
    acgacgGCAA

201 AAAACAAATC AGTTATccgA TTAAAGGCTT GCCGGAACAA
    Aacgccgtcc 251 gGCTGACCGG AAAGCATCCC AACCACTTGG AagccgtcgT
    CGGCAAATGT

301 ATGGAAACCG ACGGAAAGGA CGCGCCTTCG GGCTGGGCGG
    AAAACGGCGT

351 GTGCCATACC TTGTTTGCCA AACTGGTGGG CAATATCGCC
    GAAGACGGCG

401 GCAAACTGAC TGATTACCTG ATTTCGCATT CCGCCCTGCA
    ACCCTATCAG

451 GCAGGCAAAA GCGGCTATGC CGCCGTGCAG AACCGACGCT
    ATGTGCTGGA

501 AATCGACAGC GagggGGCGT TTTATttccg ccgccgccat
    tattgA
```

This encodes a protein having amino acid sequence <SEQ ID 430>:

```
  1 MLKIPFAVLG GCLLLAACGK SENTAEQPQN AAQSAPKPVF
    KVKYIDNTAI

51 AGLALGQSSE GKTNDGKKQI SYPIKGLPEQ NAVRLTGKHP
    NDLEAVVGKC

101 METDGKDAPS GWAENGVCHT LFAKLVGNIA EDGGKLTDYL
    ISHSALQPYQ

151 AGKSGYAAVQ NGRYVLEIDS EGAFYFRRRH Y*
```

Based on this analysis, including the presence of a predicted prokaryotic membrane lipoprotein lipid attachment site (underlined) and a putative ATP/GTP-binding site motif A (P-loop, double-underlined) in the gonococcal protein, it is predicted that the proteins from *N. meningitidis* and *N. gon-* *orrhoeae*, and their epitopes, could be useful antigens for vaccines or diagnostics, or for raising antibodies.

Example 51

The following DNA sequence was identified in *N. meningitidis* <SEQ ID 431>:

```
  1 ATGGAAGATT TATATATAAT ACTCGCTTTG GGTTTGGTTC
    CGATGATTGC

51 CGgATTTATC GATgcgatTg cGggCGGGGG TGGTTTGATT
    ACGCTGCCCG

101 CACTCTTGTT GGCAGGTATT CCTCCCGTGT CGGCAATTGC
    CACCAACAAG

151 CTGCAAgCAG CCGCTGCTAC GTTTTCAGCT ACGGTTTCTT
    TTGCACGCAA

201 AGGTTTGATT GATTGGAAGA AAGGTCTCCC GATTGCCGCA
    GCATCGTTTG

251 TAGGCGGCGT GGcCGGTGCA TTATCGGTCA GCTTGGTTTC
    CAAAGATATT

301 CTgCTgGCGG TCGTGCCGGT TTTGTTGATA TTTGTCGCAC
    TGTATTTTGT

351 GTTTTCGCCC AAGCTCGACG GCAGTAAGGA AGGCAAAGCC
    AGAATGTCTT

401 TTTTTCTGTT cGGGCTGACG GTCGC.ACCG CTTTTGGGTT
    TTTACGACGG

451 TGTGTTCGGA CCGGGTGTCG GCTCGTTTTT TCTGATTGCC
    TTTATTGTTT

501 TGCTCGGCTG CAAgCTGTTG AACGCGATGT CTTACACCAA
    ATTGGCGAAC

551 GTTGCCTGCA ATCTTGGTTC GCTATCGGTA TTCCTGCTGC
    ACGGTTCGAT

601 TATTTTCCCG ATTGCGGCAA CGaTGGCGGT CGGTGCGTTT
    GTCGGtGCGA

651 ATTTAgGTGC GAGATTTGCC GTaCgctTCG GTTCGAAGCT
    GATTAA
```

This corresponds to the amino acid sequence <SEQ ID 432; ORF109>:

```
  1 MEDLYIILAL GLVAMIAGFI DAIAGGGGLI TLPALLLAGI
    PPVSAIATNK

51 LQAAAATFSA TVSFARKGLI DWKKGLPIAA ASFVGGVAGA
    LSVSLVSKDI

101 LLAVVPVLLI FVALYFVFSP KLDGSKEGKA RMSFFLFGLT
    VXTAFGFLRR
```

```
151 CVRTGCRLVF SDCLYCFARL QAVERDVLHQ IGERCLQSWF
    AIGIPAARFD

201 YFPDCGNDGG RCVCRCEFRC EICRTLRFEA D*
```

Further work revealed the following DNA sequence <SEQ ID 433>:

```
  1 ATGGAAGATT TATATATAAT ACTCGCTTTG GGTTTGGTTG
    CGATGATTGC

51 CGGATTTATC GATGCGATTG CGGGCGGGGG TGGTTTGATT
    ACGCTGCCCG

101 CACTCTTGTT GGCAGGTATT CCTCCCGTGT CGGCAATTGC
    CACCAACAAG

151 CTGCAAGCAG CCGCTGCTAC GTTTTCAGCT ACGGTTTCTT
    TTGCACGCAA

201 AGGTTTGATT GATTGGAAGA AAGGTCTCCC GATTGCCGCA
    GCATCGTTTG

251 TAGGCGGCGT GGCCGGTGCA TTATCGGTCA GCTTGGTTTC
    CAAAGATATT

301 CTGCTGGCGG TCGTGCCGGT TTTGTTGATA TTTGTCGCAC
    TGTATTTTGT

351 GTTTTCGCCC AAGCTCGACG GCAGTAAGGA AGGCAAAGCC
    AGAATGTCTT
```

This corresponds to the amino acid sequence <SEQ ID 434; ORF109-1>:

```
  1 MEDLYIILAL GLVAMIAGFI DAIAGGGGLI TLPALLLAGI
    PPVSAIATNK

51 LQAAAATFSA TVSFARKGLI DWKKGLPIAA ASFVGGVAGA
    LSVSLVSKDI

101 LLAVVPVLLI FVALYFVFSP KLDGSKEGKA RMSFFLFGLT
    VAPLLGFYDG

151 VFGPGVGSFF LIAFIVLLGC KLLNAMSYTK LANVACNLGS
    LSVFLLHGSI

201 IFPIAATMAV GAFVGANLGA RFAVRFGSKL IKPLLIVISI
    SMAVKLLIDE

251 RNPLYQMIVS MF*
```

Computer analysis of this amino acid sequence gave the following results:

Homology with a Predicted ORF from *N. meningitidis* (Strain A)

ORF109 shows 95.9% identity over a 147aa overlap with an ORF (ORF109a) from strain A of *N. meningitidis*:

```
                      10         20         30         40         50         60
orf109.pep   MEDLYIILALGLVAMIAGFIDAIAGGGGLITLPALLLAGIPPVSAIATNKLQAAAATFSA
             ||||||||||||||||||||||||||||||||||||||||||||||||||||||||||||
orf109a      MEDLYIILALGLVAMIAGFIDAIAGGGGLITLPALLLAGIPPVSAIATNKLQAAAATFSA
                      10         20         30         40         50         60
                      70         80         90        100        110        120
orf109.pep   TVSFARKGLIDWKKGLPIAAASFVGGVAGALSVSLVSKDILLAVVPVLLIFVALYFVFSP
             ||||||||||||||||||||||:  :||||||||||||||||||||||||||||||||||
orf109a      TVSFARKGLIDWKKGLPIAAAFAGGVVGALSVSLVSKDILLAVVPVLLIFVALYFVFSP
                      70         80         90        100        110        120
                     130        140        150        160        170        180
orf109.pep   KLDGSKEGKARMSFFLFGLTVXTAFGFLRRCVRTGCRLVFSDCLYCFARLQAVERDVLHQ
             ||||||||||||||||||||||||     :||
orf109a      KLDGSKEGKARMSFFLFGLTVAPLLGFYDGVFGPGVGSFFLIAFIVLLGCKLLNAMSYTK
                     130        140        150        160        170        180
```

The complete length ORF109a nucleotide sequence <SEQ ID 435> is:

```
  1 ATGGAAGATT TATACATAAT ACTCGCTTTG GGTTTGGTTG
    CGATGATTGC

51 CGGATTTATC GATGCGATTG CGGGTGGGGG TGGTTTGATT
    ACGCTGCCTG

101 CACTCTTGTT GGCAGGTATT CCTCCCGTGT CGGCAATTGC
    CACCAACAAG

151 CTGCAAGCAG CCGCTGCTAC GTTTTCGGCT ACGGTTTCTT
    TTGCACGCAA

201 AGGTTTGATT GATTGGAAGA AAGGTCTCCC GATTGCGGCA
    GCATCGTTTG

251 CAGGCGGCGT GGTCGGTGCA TTATCGGTCA GCTTGGTTTC
    CAAAGATATT
```

-continued

```
401 TTTTTCTGTT CGGGCTGACG GTCGCACCGC TTTTGGGTTT
    TTACGACGGT

451 GTGTTCGGAC CGGGTGTCGG CTCGTTTTTT CTCATTGCCT
    TTATTGTTTT

501 GCTCGGCTGC AAGCTGTTGA ACGCGATGTC TTACACCAAA
    TTGGCGAACG

551 TTGCCTGCAA TCTTGGTTCG CTATCGGTAT TCCTGCTGCA
    CGGTTCGATT

601 ATTTTCCCGA TTGCGGCAAC GATGGCGGTC GGTGCGTTTG
    TCGGTGCGAA

651 TTTAGGTGCG AGATTTGCCG TCCGCTTCGG TTCGAAGCTG
    ATTAAGCCGC
```

```
301 CTGCTGGCGG TCGTGCCGGT TTTGTTGATA TTTGTCGCGC
    TGTATTTTGT

351 GTTTTCGCCC AAGCTCGACG GCAGTAAGGA AGGCAAAGCC
    AGAATGTCTT

401 TTTTTCTGTT CGGTCTGACG GTTGCACCAC TTTTGGGTTT
    TTACGACGGT

451 GTGTTCGGAC CGGGTGTCGG CTCGTTTTTT CTGATTGCCT
    TTATTGTTTT

501 GCTCGGCTGC AAGCTGTTGA ACGCGATGTC TTACACCAAA
    TTGGCGAACG

551 TTGCCTGCAA TCTTGGTTCG CTATCGGTAT TCCTGCTGCA
    CGGTTCGATT

601 ATTTTCCCGA TTGCGGCAAC GATGGCGGTC GGTGCGTTTG
    TCGGTGCGAA

651 TTTAGGTGCG AGATTTGCCG TCCGCTTCGG TTCGAAGCTG
    ATTAAGCCGC

701 TGCTGATTGT CATCAGCATT TCGATGGCTG TGAAATTGTT
    GATAGACGAG
```

```
751 AGAAATCCGC TGTATCAGAT GATTGTTTCG ATGTTTTAA
```

This encodes a protein having amino acid sequence <SEQ ID 436>:

```
  1 MEDLYIILAL GLVAMIAGFI DAIAGGGGLI TLPALLLAGI
    PPVSAIATNK

51 LQAAAATFSA TVSFARKGLI DWKKGLPIAA ASFAGGVVGA
    LSVSLVSKDI

101 LLAVVPVLLI FVALYFVFSP KLDGSKEGKA RMSFFLFGLT
    VAPLLGFYDG

151 VFGPGVGSFF LIAFIVLLGC KLLNAMSYTK LANVACNLGS
    LSVFLLHGSI

201 IFPIAATMAV GAFVGANLGA RFAVRFGSKL IKPLLIVISI
    SMAVKLLIDE

251 RNPLYQMIVS MF*
```

ORF109a and ORF109-1 show 99.2% identity in 262 aa overlap:

```
                      10         20         30         40         50         60
orf109a.pep   MEDLYIILALGLVAMIAGFIDAIAGGGGLITLPALLLAGIPPVSAIATNKLQAAAATFSA
              ||||||||||||||||||||||||||||||||||||||||||||||||||||||||||||
orf109-1      MEDLYIILALGLVAMIAGFIDAIAGGGGLITLPALLLAGIPPVSAIATNKLQAAAATFSA
                      10         20         30         40         50         60

70         80         90        100        110        120
orf109a.pep   TVSFARKGLIDWKKGLPIAAASFAGGVVGALSVSLVSKDILLAVVPVLLIFVALYFVFSP
              |||||||||||||||||||||||:|||:||||||||||||||||||||||||||||||||
orf109-1      TVSFARKGLIDWKKGLPIAAASFVGGVAGALSVSLVSKDILLAVVPVLLIFVALYFVFSP
                      70         80         90        100        110        120

130        140        150        160        170        180
orf109a.pep   KLDGSKEGKARMSFFLFGLTVAPLLGFYDGVFGPGVGSFFLIAFIVLLGCKLLNAMSYTK
              ||||||||||||||||||||||||||||||||||||||||||||||||||||||||||||
orf109-1      KLDGSKEGKARMSFFLFGLTVAPLLGFYDGVFGPGVGSFFLIAFIVLLGCKLLNAMSYTK
                     130        140        150        160        170        180

190        200        210        220        230        240
orf109a.pep   LANVACNLGSLSVFLLHGSIIFPIAATMAVGAFVGANLGARFAVRFGSKLIKPLLIVISI
              ||||||||||||||||||||||||||||||||||||||||||||||||||||||||||||
orf109-1      LANVACNLGSLSVFLLHGSIIFPIAATMAVGAFVGANLGARFAVRFGSKLIKPLLIVISI
                     190        200        210        220        230        240

250        260
orf109a.pep   SMAVKLLIDERNPLYQMIVSMFX
              |||||||||||||||||||||||
orf109-1      SMAVKLLIDERNPLYQMIVSMFX
                     250        260
```

Homology with a Predicted ORF from *N. gonorrhoeae*

ORF109 shows 98.3% identity over a 231aa overlap with a predicted ORF (ORF109.ng) from *N. gonorrhoeae*:

```
orf109.pep    MEDLYIILALGLVAMIAGFIDAIAGGGGLITLPALLLAGIPPVSAIATNKLQAAAATFSA    60
              ||||||||||||||||||||||||||||||||||||||||||||||||||||||||||||
orf109ng      MEDLYIILALGLVAMIAGFIDAIAGGGGLITLPALLLAGIPPVSAIATNKLQAAAATFSA    60 orf109.pep    TVSFARKGLIDWKKGLPIAAASFVGGVAGALSVSLVSKDILLAVVPVLLIFVALYFVFSP   120
              |||||||||||||||||||||||:|||:||||||||||||||||||||||||||||||||
orf109ng      TVSFARKGLIDWKKGLPIAAASFAGGVVGALSVSLVSKDILLAVVPVLLIFVALYFVFSP   120 orf109.pep    KLDGSKEGKARMSFFLFGLTVXTAFGFLRRCVRTGCRLVFSDCLYCFARLQAVERDVLHQ   180
              |||||||||||||||||||||| |||||||||||||||||||||||||||||||||||||
orf109ng      KLDGSKEGKARMSFFLFGLTVATAFGFLRRCVRTGCRLVFSDCLYCFARLQAVERDVLHQ   180
```

```
                                      -continued
orf109.pep       IGERCLQSWFAIGIPAARFDYFPDCGNDGGRCVCRCEFRCEICRTLRFEAD   231
                 ||||||||||||||||||||||||||||||||||||||||||||| |||||
orf109ng         IGERCLQSWFAIGIPAARFDYFPDCGNDGGRCVCRCEFRCEICRPLRFEAD   231
```

An ORF109ng nucleotide sequence <SEQ ID 437> was predicted to encode a protein having amino acid sequence <SEQ ID 438>:

```
  1 MEDLYIILAL GLVAMIAGFI DAIAGGGGLI TLPALLLAGI
    PPVSAIATNK

51 LQAAAATFSA TVSFARKGLI DWKKGLPIAA ASFAGGVVGA
    LSVSLVSKDI

101 LLAVVPVLLI FVALYFVFSP KLDGSKEGKA RMSFFLFGLT
    VATAFGFLRR

151 CVRTGCRLVF SDCLYCFARL QAVERDVLHQ IGERCLQSWF
    AIGIPAARFD

201 YFPDCGNDGG RCVCRCEFRC EICRPLRFEA D*
```

Further work revealed the following gonococcal DNA sequence <SEQ ID 439>:

```
  1 ATGGAAGATT TATACATAAT ACTCGCTTTG GGTTTGGTTG
    CGATGATCGC

51 CGGATTTATC GATGCGATTG CGGGCGGGGG TGGTTTGATT
    ACGCTGCCTG

101 CACTCTTGTT GGCAGGTATT CCTCCCGTGT CGGCAATTGC
    CACCAACAAG

151 CTGCAAGCAG CCGCTGCTAC GTTTTCGGCT ACGGTTTCTT
    TTGCACGCAA

201 AGGTTTGATT GATTGGAAGA AAGGTCTCCC GATTGCCGCA
    GCATCGTTTG

251 CAGGCGGCGT GGTCGGTGCA TTATCGGTCA GCTTGGTTTC
    CAAAGATATT

301 TTGCTGGCGG TCGTGCCGGT TTTGTTGATA TTTGTCGCGC
    TGTATTTTGT

351 GTTTTCGCCC AAGCTCGACG GCAGTAAGGA AGGCAAAGCC
    AGAATGTCTT

401 TTTTTCTATT CGGGCTGACG GTTGCACCGC TTTTGGGTTT
    TTACGACGGT

451 GTGTTCGGAC CGGGTGTCGG CTCGTTTTTT CTCATTGCCT
    TTATTGTTTT

501 GCTCGGCTGC AAGCTGTTGA ACGCGATGTC TTACACCAAA
    TTGGCGAACG

551 TTGCTTGCAA TCTTGGTTCG CTATCGGTAT TCCTGCTGCA
    CGGTTCGATT

601 ATTTTCCCGA TTGTGGCAAC GATGGCGGTC GGTGCGTTTG
    TCGGTGCGAA

651 TTTAGGTGCG AGATTTGCCG TCCGCTTCGG TTCGAAGCTG
    ATTAAGCCGC

701 TGCTGATTGT CATCAGCATT TCGATGGCTG TGAAATTGTT
    GATAGACGAG

751 AGAAATCCGC TGTATCAGAT GATTGTTTCG ATGTTTTAA
```

This corresponds to the amino acid sequence <SEQ ID 440; ORF109ng-1>:

```
  1 MEDLYIILAL GLVAMIAGFI DAIAGGGGLI TLPALLLAGI
    PPVSAIATNK

51 LQAAAATFSA TVSFARKGLI DWKKGLPIAA ASFAGGVVGA
    LSVSLVSKDI

101 LLAVVPVLLI FVALYFVFSP KLDGSKEGKA RMSFFLFGLT
    VAPLLGFYDG

151 VFGPGVGSFF LIAFIVLLGC KLLNAMSYTK LANVACNLGS
    LSVFLLHGSI

201 IFPIVATMAV GAFVGANLGA RFAVRFGSKL IKPLLIVISI
    SMAVKLLIDE

251 RNPLYQMIVS MF*
```

ORF109ng-1 and ORF109-1 show 98.9% identity in 262 aa overlap:

```
                          10         20         30         40         50         60
orf109ng-1.pep   MEDLYIILALGLVAMIAGFIDAIAGGGGLITLPALLLAGIPPVSAIATNKLQAAAATFSA
                 ||||||||||||||||||||||||||||||||||||||||||||||||||||||||||||
orf109-1         MEDLYIILALGLVAMIAGFIDAIAGGGGLITLPALLLAGIPPVSAIATNKLQAAAATFSA
                          10         20         30         40         50         60

70         80         90        100        110        120
orf109ng-1.pep   TVSFARKGLIDWKKGLPIAAASFAGGVVGALSVSLVSKDILLAVVPVLLIFVALYFVFSP
                 ||||||||||||||||||||||||:|||:||||||||||||||||||||||||||||||
orf109-1         TVSFARKGLIDWKKGLPIAAASFVGGVAGALSVSLVSKDILLAVVPVLLIFVALYFVFSP
                          70         80         90        100        110        120

130        140        150        160        170        180
orf109ng-1.pep   KLDGSKEGKARMSFFLFGLTVAPLLGFYDGVFGPGVGSFFLIAFIVLLGCKLLNAMSYTK
                 ||||||||||||||||||||||||||||||||||||||||||||||||||||||||||||
orf109-1         KLDGSKEGKARMSFFLFGLTVAPLLGFYDGVFGPGVGSFFLIAFIVLLGCKLLNAMSYTK
                         130        140        150        160        170        180
```

-continued

```
                          190        200        210        220        230        240
orf109ng-1.pep   LANVACNLGSLSVFLLHGSIIFPIVATMAVGAFVGANLGARFAVRFGSKLIKPLLIVISI
                 ||||||||||||||||||||||||:|||||||||||||||||||||||||||||||||||
orf109-1         LANVACNLGSLSVFLLHGSIIFPIAATMAVGAFVGANLGARFAVRFGSKLIKPLLIVISI
                          190        200        210        220        230        240
                          250        260
orf109ng-1.pep   SMAVKLLIDERNPLYQMIVSMFX
                 |||||||||||||||||||||||
orf109-1         SMAVKLLIDERNPLYQMIVSMFX
                          250        260
```

In addition, ORF109ng-1 shows homology to a hypothetical *Pseudomonas* protein:

```
sp|P29942|YCB9_PSEDE HYPOTHETICAL 27.4 KD PROTEIN IN COBO 3'REGION (ORF9)
>gi|94984|pir||I38164 hypothetical protein 9 - Pseudomonas sp >gi|551929
(M62866) ORF9 [Pseudomonas denitrificans] Length = 261
Score = 175 bits (439), Expect = 3e-43
Identities = 83/214 (38%), Positives = 131/214 (60%), Gaps = 1/214 (0%)

Query:  41 PPVSAIATNKLQXXXXXXXXXXXXXXRKGLIDWKKGLPIXXXXXXXXXXXXXXXXXXXKDI  100
           PP+   + TNKLQ              R+G ++ K+ LP+                  D+
Sbjct:  43 PPLQTLGTNKLQGLFGSGSATLSYARRGHVNLKEQLPMALMSAAGAVLGALLATIVPGDV  102

Query: 101 LLAVVPVLLIFVALYFVFSPKLDGSKEGKARMSFFLFGLTVAPLLGFYDGVFGPGVGSFF  160
           L A++P LLI +ALYF   P + G +  +R+++F+F LT+ PL+GFYDGVFGPG GSFF
Sbjct: 103 LKAILPFLLIAIALYFGLKPNM-GDVDQHSRVTPFVFTLTLVPLIGFYDGVFGPGTGSFF  161

Query: 161 LIAFIVLLGCKLLNAMSYTKLANVACNLGSLSVFLLHGSIIFPIVATMAVGAFVGANLGA  220
           ++ F+ L G  +L A ++TK  N N+G+      VFL G++++ +   M +G F+GA +G+
Sbjct: 162 MLGFVTLAGFGVLKATAHTKFLNFGSNVGAFGVFLFFGAVLWKVGLLMGLGQFLGAQVGS  221

Query: 221 RFAVRFGSKLIKPLLIVISISMAVKLLIDERNPL                           254
           R+A+   G+K+IKPLL+++SI++A++LL D  +PL
Sbjct: 222 RYAMAKGAKIIKPLLVIVSIALAIRLLADPTHPL                           255
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 52

The following partial DNA sequence was identified in *N. meningitidis* <SEQ ID 441>:

```
  1 . . . CTGCTAGGGT ATTGCATCGG TTATCGGTAC
        GGCTGTTGCA GCAAAACCAG

51 CCGCAGACGG ATTATTTGGT CAAATTCGGA TCGTTTTGGG
        CGAG.ATTTT

101 TGGTTTTCTG GGACTGTATG ACGTCTATGC TTCGGCATGG
        TTTGTCGTTA

151 TCATGATGTT TTTGGTGGTT CTACCAGTT TGTGCCTGAT
        TCGCAATGTG

201 CCGCCGTTCT GGCGCGAAAT GAAGTCTTTT CGGGAAAAGG
        TTAAAGAAAA

251 ATCTCTGGCG GCGATGCGCC ATTCTTCGCT GTTGGATGTA
        AAAATTGCGC

301 CCGAGGTTGC CAAACGTTAT CTGGAAGTAC AAGGTTTTCA
        GGGGAAAACC

351 ATTAACCGTG AAGACGGGTC GGTTCTGATT GCCGCCAAAA
        AAGGCACAAT

401 GAACAAATGG GGCTATATCT TTGCCCATGT TGCTTTGATT
        GTCATTTGCC

451 TGGGCGGGTT GATAGACAGT AACCTGCTGT TGAAACTGGG
        TATGCTGACC

501 GGTCGGATTG TTCCGGACAA TCAGGCGGTT TATGCCAAGG
        ATTTC.AAGC

551 CCGAAAGTAT .TTTGGGTGC gTCCAATCTC TCATTTAGGG
        GCAACGTCAA

601 TATTTCCG.A GGGGCAGAgT GCGGATGTGG TTTTCCTGA
```

This corresponds to the amino acid sequence <SEQ ID 442; ORF110>:

```
  1 . . . LLGIASVIGT LLQQNQPQTD YLVKFGSFWA
        XIFGFLGLYD VYASAWFVVI

51 MMFLVVSTSL CLIRNVPPFW REMKSFREKV KEKSLAAMRH
        SSLLDVKIAP

101 EVAKRYLEVQ GFQGKTINRE DGSVLIAAKK GTMNKWGYIF
        AHVALIVICL

151 GGLIDSNLLL KLGMLTGRIF RTIRRFMPRI XKPESXFGCV
        QSLI*GQRQY

201 FXRGRVRMWF S*
```

Computer analysis of this amino acid sequence gave the following results:

Homology with ORF88a from *N. meningitidis* (Strain A)
ORF110 shows 91.5% identity over a 188aa overlap with ORF88a from strain A of *N. meningitidis*:

```
                    10        20        30        40        50        60
orf88a.pep  MSKSRRSPPLLSRPWFAFFSSMRFAVALLSLLGIASVIGTVLQQNQPQTDYLVKFGSFWA
                                    |||||||||:|||||||||||||||||||
orf110                              LLGIASVIGTLLQQNQPQTDYLVKFGSFWA
                                            10        20        30
                    70        80        90       100       110       120
orf88a.pep  QIFGFLGLYDVYASAWFVVIMMFLVVSTSLCLIRNVPPFWREMKSFREKVKEKSLAAMRH
            ||||||||||||||||||||||||||||||||||||||||||||||||||||||||||||
orf110      XIFGFLGLYDVYASAWFVVIMMFLVVSTSLCLIRNVPPFWREMKSFREKVKEKSLAAMRH
                    40        50        60        70        80        90
                   130       140       150       160       170       180
orf88a.pep  SSLLDVKIAPEVAKRYLEVQGFQGKTINREDGSVLIAAKKGTMNKWGYIFAHVALIVICL
            ||||||||||||||||||||||||||||||||||||||||||||||||||||||||||||
orf110      SSLLDVKIAPEVAKRYLEVQGFQGKTINREDGSVLIAAKKGTMNKWGYIFAHVALIVICL
                   100       110       120       130       140       150
                   190       200       210       220       230       240
orf88a.pep  GGLIDSNLLLKLGMLTGRIVPDNQAVYAKDFKPESILGASNLSFRGNVNISEGQSADVVF
            ||||||||||||||||||||    :   :  :  ||||   :|
orf110      GGLIDSNLLLKLGMLTGRIFRTIRRFMPRIXKPESXFGCVQSLIXGQRQYFXRGRVRMWF
                   160       170       180       190       200       210
                   250       260       270       280       290       300
orf88a.pep  LNADNGILVQDLPFEVKLKKFHIDFYNTGMPRDFASDIEVTDKATGEKLERTIRVNHPLT orf110      SX
```

However, ORF88 and ORF110 do not align, because they represent two different fragments of the same protein.

Homology with a Predicted ORF from *N. gonorrhoeae*
ORF110 shows 88.6% identity over a 21 laa overlap with a predicted ORF (ORF110.ng) from *N. gonorrhoeae*:

```
orf110.pep                              LLGIASVIGTLLQQNQPQTDYLVKFGSFWA   30
                                        |||||||||:|||||||||||||||| ||:
orf110ng    MSKSRISPTLLSRPWFAFFSSMRFAVALLSLLGIASVIGTVLQQNQPQTDYLVKFGPFWT   60
orf110.pep  XIFGFLGLYDVYASAWFVVIMMFLVVSTSLCLIRNVPPFWREMKSFREKVKEKSLAAMRH   90
             ||  |||||||||||||||||||||||||||||||||||||||||||||||||||||||
orf110ng    RIFDFLGLYDVYASAWFVVIMMFLVVSTSLCLIRNVPPFWREMKSFREKVKEKSLAAMRH  120
orf110.pep  SSLLDVKIAPEVAKRYLEVQGFQGKTINREDGSVLIAAKKGTMNKWGYIFAHVALIVICL  150
            ||||||||||||||||||||:||||||::|||||||||||||||||||| ||||||||||
orf110ng    SSLLDVKIAPEVAKRYLEVRGFQGKTVSREDGSVLIAAKKGTMNKWGYIXAHVALIVICL  180
orf110.pep  GGLIDSNLLLKLGMLTGRIFRTIRRFMPRIXKPESXFGCVQSLIXGQRQYFXRGRVRMWF  210
            |  ||: |||||||||:|  ||| :| |||| |||| :| ||||| |||||| ||:||||
orf110ng    GRLINXNLLLKLGMLAGSIFRNNRRVMPRISKPESIWGGVQSLIKGQRQYFQRGKVRMWF  240
orf110.pep  S   211
            |
orf110ng    S   241
```

The complete length ORF110ng nucleotide sequence <SEQ ID 443> is predicted to encode a protein having amino acid sequence <SEQ ID 444>:

```
1  MSKSRISPTL LSRPWFAFFS SMRFAVALLS LLGIASVIGT
   VLQQNQPQTD
```

```
 51 YLVKFGPFWT RIFDFLGLYD VYASAWFVVI MMFLVVSTSL
    CLIRNVPPFW

101 REMKSFREKV KEKSLAAMRH SSLLDVKIAP EVAKRYLEVR
    GFQGKTVSRE

151 DGSVLIAAKK GTMNKWGYIX AHVALIVICL GRLINXNLLL
    KLGMLAGSIF

201 RNNRRVMPRI SKPESIWGGV QSLIKGQRQY FQRGKVRMWF
    S*
```

Based on the putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 53

The following DNA sequence was identified in *N. meningitidis* <SEQ ID 445>:

```
  1 ATGCCGTCTG AAACACGCCT GCCGAACTTT ATCCGCGTCT
    TGATATTTGC

51 CCTGGGTTTC ATCTTCCTGA ACGCCTGTTC GGAACAAACC
    GCGCAAACCG

101 TTACCCTGCA AGGCGAAACG ATGGGCACGA CCTATACCGT
    CAAATACCTT

151 TCAAATAATC GGGACAAACT CCCCTCACCT GCCGAAATAC
    AAAAACGCAT

201 CGATGACGCG CTTAAAGAAG TCAACCGGCA GATGTCCACC
    TATCAGCCCG

251 ACTCCGAAAT CAGCCGGTTC AACCAACACA CAGCCGGCAA
    GCCCCTCCGC

301 ATTTCAAGCG ACTTCGCACA CGTTACTGCC GAAGCCGTCC
    GCCTGAACCG

351 CCTGACACAC GGCGCGCTGG ACGTAACCGT CGGCCCCTTG
    GTCAACCTTT

401 GGGGATTCGG CCCCGACAAA TCCGTTACCC GTGAACCGTC
    GCCGGAACAA

451 ATCAAACAGG CGGCATCTTA TACGGGCATA GACAAAATCA
    TTTTGAAACA

501 AGGCAAAGAT TACGCTTCCT TGAGCAAAAC CCACCCCAAG
    GCCTATTTGG

551 ATTTATCTTC GATTGCCAAA GCCTTCGGCG TTGATAAAGT
    TGCGGGCGAA

601 CTGGAAAAAT ACGGCATTCA AAATTATCTG GTCGAAATCG
    GCGGCGAGTT

651 GCACGGCAAA GGCAAAACG CGCGCGGCGA ACCGTGGCGC
    ATCGGTATCG

701 AGCAGCCCAA TATCGTCCAA GGCGGCAATA CGCAGATTAT
    CGTCCCGCTG

751 AACAACCGTT CGCTTGCCAC TTCCGGCGAT TACCGTATTT
    TCCACGTCGA
```

```
801 TAAAAACGGC AAACGCCTCT CCCATATCAT CAACCCGAAC
    AACAAACGAC

851 CCATCAGCCA CAACCTCGCC TCCATCAGCG TGGTCGCAGA
    CAGTGCGATG

901 ACGGCGGACG GCTTGTCCAC AGGATTATTC GTATTGGGCG
    AAACCGAAGC

951 CTTAAAGCTG GCAGAGCGCG AAAAACTCGC TGTTTTCCTG
    ATTGTCAGGG

1001 ATAAAGGCGG CTACCGCACC GCCATGTCTT CCGAATTTGA
     AAAACTGCTC

1051 CGCTAA
```

This corresponds to the amino acid sequence <SEQ ID 446; ORF111>:

```
  1 MPSETRLPNF IRVLIFALGF IFLNACSEQT AQTVTLQGET
    MGTTYTVKYL

51 SNNRDKLPSP AEIQKRIDDA LKEVNRQMST YQPDSEISRF
    NQHTAGKPLR

101 ISSDFAHVTA EAVRLNRLTH GALDVTVGPL VNLWGFGPDK
    SVTREPSPEQ

151 IKQAASYTGI DKIILKQGKD YASLSKTHPK AYLDLSSIAK
    GFGVDKVAGE

201 LEKYGIQNYL VEIGGELHGK GKNARGEPWR IGIEQPNIVQ
    GGNTQIIVPL

251 NNRSLATSGD YRIFHVDKNG KRLSHIINPN NKRPISHNLA
    SISVVADSAM

301 TADGLSTGLF VLGETEALKL AEREKLAVFL IVRDKGGYRT
    AMSSEFEKLL

351 R*
```

Computer analysis of this amino acid sequence gave the following results:

Homology with a Predicted ORF from *N. meningitidis* (Strain A)

ORF111 shows 96.9% identity over a 351 aa overlap with an ORF (ORF111a) from strain A of *N. meningitidis*:

```
             10        20        30        40        50        60
orf111a.pep  MPSETRLPNFIRTLIFALSFIFLNACSEQTAQTVTLQGETMGTTYTVKYLSNNRDXLPSP
             ||||||||||||:||||:||||||||||||||||||||||||||||||||||||| ||||
orf111       MPSETRLPNFIRVLIFALGFIFLNACSEQTAQTVTLQGETMGTTYTVKYLSNNRDKLPSP
             10        20        30        40        50        60

70        80        90        100       110       120
orf111a.pep  AEIQXRIDDALKEVNRQMSTYQPDSEISRFNQHTAGKPLRISSDFAHVTAEAVHLNRLTH
             ||||  ||||||||||||||||||||||||||||||||||||||||||||||:|||||
orf111       AEIQKRIDDALKEVNRQMSTYQPDSEISRFNQHTAGKPLRISSDFAHVTAEAVRLNRLTH
             70        80        90        100       110       120

130       140       150       160       170       180
orf111a.pep  GALDVTVGPLVNLWGFGPDKSVTREPSPEQIKQAASYTGIDKIILKQGKDYASLSKTHPK
             ||||||||||||||||||||||||||||||||||||||||||||||||||||||||||||
orf111       GALDVTVGPLVNLWGFGPDKSVTREPSPEQIKQAASYTGIDKIILKQGKDYASLSKTHPK
             130       140       150       160       170       180

190       200       210       220       230       240
orf111a.pep  AYLDLSSIAKGFGVDXVAGELEKYGIQNYLVEIGGELHGKXKNARGEPWRIGIEQPNIVQ
             ||||||||||||||| ||||||||||||||||||||||||| ||||||||||||||||||
orf111       AYLDLSSIAKGFGVDKVAGELEKYGIQNYLVEIGGELHGKGKNARGEPWRIGIEQPNIVQ
             190       200       210       220       230       240

250       260       270       280       290       300
orf111a.pep  GGNTQIIVPLNNRSXATSGDYRIFHVDKSGKRLSHIINPNNKRPISHNLASISVXADSAM
             |||||||||||||| ||||||||||||||:|||||||||||||||||||||||| |||||
orf111       GGNTQIIVPLNNRSLATSGDYRIFHVDKNGKRLSHIINPNNKRPISHNLASISVVADSAM
             250       260       270       280       290       300

310       320       330       340       350
orf111a.pep  TADGXSTGLFVLGETEALKLAEREKLAVFLIVRDKGGYRTAMSSEFEKLLRX
             |||| |||||||||||||||||||||||||||||||||||||||||||||||
orf111       TADGLSTGLFVLGETEALKLAEREKLAVFLIVRDKGGYRTAMSSEFEKLLRX
             310       320       330       340       350
```

The complete length ORF111a nucleotide sequence <SEQ ID 447> is:

```
  1 ATGCCGTCTG AAACACGCCT GCCGAACTTT ATCCGCACCT TGATATTTGC
 51 CCTGAGTTTT ATCTTCCTGA ACGCCTGTTC GGAACAAACC GCGCAAACCG
101 TTACCCTGCA AGGTGAAACG ATGGGCACGA CCTATACCGT CAAATACCTT
151 TCAAATAATC GGGACNAACT CCCNTCACCT GCCGAAATAC AAAANCGCAT
201 CGATGACGCG CTTAAAGAAG TCAACCGGCA GATGTCCACC TATCAGCCCG
251 ACTCCGAAAT CAGCCGGTTC AACCAACACA CAGCCGGCAA GCCCCTCCGC
301 ATTTCAAGCG ACTTCGCACA CGTTACTGCC GAAGCCGTCC ACCTGAACCG
351 CCTGACACAC GGCGCGCTGG ACGTAACCGT CGGCCCCTTG GTCAACCTTT
401 GGGGATTCGG CCCCGACAAA TCCGTTACCC GTGAACCGTC GCCGGAACAA
451 ATCAAACAAG CAGCATCTTA TACGGGCATA GACAAAATCA TTTTGAAACA
501 AGGCAAAGAT TACGCTTCCT TGAGCAAAAC CCACCCCAAG GCCTATTTGG
551 ATTTATCTTC GATTGCCAAA GGCTTCGGCG TTGATNANGT TGCGGGCGAA
601 CTGGAAAAAT ACGGCATTCA AAATTATCTG GTCGAAATCG GCGGNGAGTT
651 GCACGGCAAA GNCAAAAACG CGCGCGGCGA ACCTTGGCGC ATCGGCATCG
701 AACAGCCCAA CATCGTCCAA GGCGGCAATA CGCAGATTAT CGTCCCGCTG
751 AACAACCGTT CGNTTGCCAC TTCCGGCGAT TACCGTATTT CCACGTCGA
801 TAAAAGCGGC AAACGCCTCT CCCATATCAT TAATCCGAAC AACAAACGAC
851 CCATCAGCCA CAACCTCGCC TCCATCAGCG TGNTCGCAGA CAGTGCGATG
901 ACGGCGGACG GCTTNTCCAC AGGATTATTC GTATTGGGCG AAACCGAAGC
951 CTTAAAGCTG GCAGAGCGCG AAAAACTCGC TGTTTTCCTG ATTGTCAGGG
```

```
1001 ATAAAGGCGG CTACCGCACC GCCATGTCTT CCGAATTTGA AAAACTGCTC

1051 CGCTAA
```

This encodes a protein having amino acid sequence <SEQ ID 448>:

```
  1 MPSETRLPNF IRTLIFALSF IFLNACSEQT AQTVTLQGET MGTTYTVKYL

51 SNNRDXLPSP AEIQXRIDDA LKEVNRQMST YQPDSEISRF NQHTAGKPLR

101 ISSDFAHVTA EAVHLNRLTH GALDVTVGPL VNLWGFGPDK SVTREPSPEQ

151 IKQAASYTGI DKIILKQGKD YASLSKTHPK AYLDLSSIAK GFGVDXVAGE

201 LEKYGIQNYL VEIGGELHGK XKNARGEPWR IGIEQPNIVQ GGNTQIIVPL

251 NNRSXATSGD YRIFHVDKSG KRLSHIINPN NKRPISHNLA SISVXADSAM

301 TADGXSTGLF VLGETEALKL AEREKLAVFL IVRDKGGYRT AMSSEFEKLL

351 R*
```

Homology with a Predicted ORF from *N. gonorrhoeae*

ORF111 shows 96.6% identity over a 351aa overlap with a predicted ORF (ORF111.ng) from *N. gonorrhoeae*:

```
                   10         20         30         40         50         60
orf111ng   MPSETRLPNLIRALIFALGFIFLNACSEQTAQTVTLQGETMGTTYTVKYLSNNRDKLPSP
           ||||||||||:||:||||||||||||||||||||||||||||||||||||||||||||||
orf111     MPSETRLPNFIRVLIFALGFIFLNACSEQTAQTVTLQGETMGTTYTVKYLSNNRDKLPSP
                   10         20         30         40         50         60
                   70         80         90        100        110        120
orf111     AKIQKRIDDALKEVNRQMSTYQTDSEISRFNQHTAGKPLRISSDFAHVTAEAVRLNRLTH
           |:|||||||||||||||||||||| |||||||||||||||||||||||||||||||||||
orf111     AEIQKRIDDALKEVNRQMSTYQPDSEISRFNQHTAGKPLRISSDFAHVTAEAVRLNRLTH
                   70         80         90        100        110        120
                  130        140        150        160        170        180
orf111ng   GALDVTVGPLVNLWGFGPDKSVTREPSPEQIKQAASYTGIDKIILQQGKDYASLSKTHPK
           |||||||||||||||||||||||||||||||||||||||||||||:||||||||||||||
orf111     GALDVTVGPLVNLWGFGPDKSVTREPSPEQIKQAASYTGIDKIILKQGKDYASLSKTHPK
                  130        140        150        160        170        180
                  190        200        210        220        230        240
orf111ng   AYLDLSSIAKGFGVDKVAGELEKYGIQNYLVEIGGELHGKGKNAHGEPWRIGIEQPNIIQ
           ||||||||||||||||||||||||||||||||||||||||||:||||||||||||||:|
orf111     AYLDLSSIAKGFGVDKVAGELEKYGIQNYLVEIGGELHGKGKNARGEPWRIGIEQPNIVQ
                  190        200        210        220        230        240
                  250        260        270        280        290        300
orf111ng   GGNTQIIVPLNNRSLATSGDYRIFHVDKNGKRLSHIINPNNKRPISHNLASISVSDSAM
           |||||||||||||||||||||||||||||||||||||||||||||||||||||:||||
orf111     GGNTQIIVPLNNRSLATSGDYRIFHVDKNGKRLSHIINPNNKRPISHNLASISVVADSAM
                  250        260        270        280        290        300
                  310        320        330        340        350
orf111ng   TADGLSTGLFVLGETEALRLAEQEKLAVFLIVRDKDGYRTAMSSEFAKLLRX
           ||||||||||||||||||||:|||:|||||||||||| ||||||||||:||||||
orf111     TADGLSTGLFVLGETEALKLAEREKLAVFLIVRDKGGYRTAMSSEFEKLLRX
                  310        320        330        340        350
```

The complete length ORF111ng nucleotide sequence <SEQ ID 449> is:

```
  1 ATGCCGTCTG AAACACGCCT GCCGAACCTT ATCCGCGCCT TGATATTTGC

51 CCTGGGTTTC ATCTTCCTGA ACGCCTGTTC GGaacaaacC GCGCAaaccg
```

-continued

```
 101 TTACCCTGCA AGGCGAAAcg aTGGGTACGA CCTATACCGT CAAATACCTT
 151 TCAAATAATC GGGACAAACT CCCCTCCCCT GCCAAAATAC AAAAGCGCAT
 201 TGATGATGCG CTTAAAGAAG TCAACCGGCA GATGTCCACC TACCAGACCG
 251 ATTCCGAAAT CAGCCGGTTC AACCAACACA CAGCCGGCAA GCCCCTCCGC
 301 ATTTCAAGCG ATTTCGCACA CGTTACCGCC GAAGCCGTCC GCCTGAACCG
 351 CCTGACTCAC GGCGCACTGG ACGTAACCGT CGGCCCTTTG GTCAACCTTT
 401 GGGGGTTCGG CCCCGACAAA TCCGTTACCC GTGAACCGTC GCCGGAACAA
 451 ATCAAACAGG CGGCATCTTA TACGGGCATA GACAAAATCA TTTTGCAACA
 501 AGGCAAAGAT TACGCTTCCT TGAGCAAAAC CCACCCCAAA GCCTATTTGG
 551 ATTTATCTTC GATTGCCAAA GGCTTCGGCG TTGATAAAGT TGCGGGCGAA
 601 CTGGAAAAAT ACGGCATTCA AAATTATCTG GTCGAAAtcg gcggcGAGTT
 651 GCACGGCAAA GGCAAAAATG CGCACGGCGA ACCGTGGCGC ATCGGTATAG
 701 AGCAACCCAA TATCATCCAA GgcgGCAata CGCAGATTAt cgtcccgctg
 751 aaCaaccgtt cgctTGCCAC TTCCGGCGAT TAccgtaTTT tccacgtcgA
 801 TAAAAAcggc aaacgcctttt cccacaTCAT CAATCCCaAC aacAAACgac
 851 ccATCAGcca caacctcgcc tccatcagcg tggtctcAGA CAGTGCAATG
 901 ACGGCGGACG GTTtatCCAC AGGATTATTT GTTTTAGGCG AAACCGAAGC
 951 CTTAAGGCTG GCAGAACAAG AAAAACTCGC TGTTTTCCTA ATTGTCCGGG
1001 ATAAGGACGG CTACCGCACC GCCATGTCTT CCGAATTTGC CAAGCTGCTC
1051 CGCTAA
```

This encodes a protein having amino acid sequence <SEQ ID 450>:

```
  1 MPSETRLPNL IRALIFALGF IFLNACSEQT AQTVTLQGET MGTTYTVKYL
 51 SNNRDKLPSP AKIQKRIDDA LKEVNRQMST YQTDSEISRF NQHTAGKPLR
101 ISSDFAHVTA EAVRLNRLTH GALDVTVGPL VNLWGFGPDK SVTREPSPEQ
151 IKQAASYTGI DKIILQQGKD YASLSKTHPK AYLDLSSIAK GFGVDKVAGE
201 LEKYGIQNYL VEIGGELHGK GKNAHGEPWR IGIEQPNIIQ GGNTQIIVPL
251 NNRSLATSGD YRIFHVDKNG KRLSHIINPN NKRPISHNLA SISVVSDSAM
301 TADGLSTGLF VLGETEALRL AEQEKLAVFL IVRDKDGYRT AMSSEFAKLL
351 R*
```

This protein shows homology with a hypothetical lipoprotein precursor from *H. influenzae*:

```
sp|P44550|YOJL_HAEIN HYPOTHETICAL LIPOPROTEIN HI0172 PRECURSOR
>gi|1074292|pir|4 hypothetical protein HI0172 - Haemophilus influenzae
(strain Rd KW20)
>gi|1573128 (U32702) hypothetical [Haemophilus influenzae] Length = 346
  Score = 353 bits (896), Expect = 9e-97
  Identities = 181/344 (52%), Positives = 247/344 (71%),
  Gaps = 4/344 (1%)
```

```
                            -continued
Query:    7 LPNLIRALIFALGFIFLNACSEQTAQTVTLQGETMGTTYTVKYLSNNRDKLPSPAKIQKR  66
            + LI +I    + L AC ++T + ++L G+TMGTTY VKYL +     S  K  +
Sbjct:    1 MKKLISGIIAVAMALSLAACQKET-KVISLSGKTMGTTYHVKYLDDGSITATSE-KTHEE  58

Query:   67 IDDALKEVNRQMSTYQTDSEISRFNQHT-AGKPLRISSDFAHVTAEAVRLNRLTHGALDV 125
            I+  LK+VN +MSTY+ DSE+SRFNQ+T    P+ IS+DFA V AEA+RLN++T GALDV
Sbjct:   59 IEAILKDVNAKMSTYKKDSELSRFNQNTQVNTPIEISADFAKVLAEAIRLNKVTEGALDV 118

Query:  126 TVGPLVNLWGFGPDKSVTREPSPEQIKQAASYTGIDKIILQQGKDYASLSKTHPKAYLDL 185
            TVGP+VNLWGFGP+K   ++P+PEQ+ +  ++ GIDKI L   K+ A+LSK  P+ Y+DL
Sbjct:  119 TVGPVVNLWGFGPEKRPEKQPTPEQLAERQAWVGIDKITLDTNKEKATLSKALPQVYVDL 178

Query:  186 SSIAKGFGVDKVAGELEKYGIQNYLVEIGGELHGKGKNAHGEPWRIGIEQPNIIQGGNTQ 245
            SSIAKGFGVD+VA +LE+   QNY+VEIGGE+  KGKN  G+PW+I IE+P         +
Sbjct:  179 SSIAKGFGVDQVAEKLEQLNAQNYMVEIGGEIRAKGKNIEGKPWQIAIEKPTTTGERAVE 238

Query:  246 IIVPLNNRSLATSGDYRIFHVDKNGKRLSHIINPNNKRPISHNLASISVVSDSAMTADGL 305
               ++ LNN  +A+SGDYRI+  ++NGKR +H I+P     PI H+LASI+V++ ++MTADGL
Sbjct:  239 AVIGLNNMGMASSGDYRIY-FEENGKRFAHEIDPKTGYPIQHHLASITVLAPTSMTADGL 297

Query:  306 STGLFVLGETEALRLAEQEKLAVFLIVRDKDGYRTAMSSEFAKL                 349
            STGLFVLGE +AL +AE+   LAV+LI+R  +G+ T  SS F  KL
Sbjct:  298 STGLFVLGEDKALEVAEKNNLAVYLIIRTDNGFVTKSSSAFKKL                 341
```

Based on this analysis, it is predicted that the proteins from *N. meningitidis* and *N. gonorrhoeae*, and their epitopes, could be useful antigens for vaccines or diagnostics, or for raising antibodies.

Example 54

The following partial DNA sequence was identified in *N. meningitidis* <SEQ ID 451>:

```
  1 ..CCGTGCCGCC GACAGGGCGA CGACGTGTAT GCGGCGCACG CGTCCCGTCA
 51   AAAATTGTGG CTGCGCTTCA TCGGCGGCCG GTCGCATCAA AATATACGGG
101   GCGGCGCGGC TGCGGACGGG TGGCGCAAAG GCGTGCAAAT CGGCGGCGAG
151   GTGTTTGTAC GGCAAAATGA AGGCAGCCkA yTGGCAATCG GCGTGATGGG
201   CGGCAGGGCC GGCCAGCACG CwTCAGTCAA CGGCAAAGGC GGTGCGGCAG
251   gCAGTGATTT GTATGGTTAT GgCGGGGgTG TTTATGCTgC GTGGCATCAG
301   TTGCGCGATA ACAAACGGG TgCGTATTTG GACGGCTGGT TGCAATACCA
351   ACGTTTCAAA CACCGCATCA ATGATGAAAA CCGTGCGGAA CgCTACAAAA
401   CCAAAGGTTG GACGGCTTCT GTCGAAGGCG GCTACAACGC GCTTGTGGCG
451   GAAGGCATTG TCGGAAAAGG CAATAATGTG CGGTTTTACC TACAACCGCA
501   GgCGCAGTTT ACCTACTTGG GCGTAAACGG CGGCTTTACC GACAGCGAGG
551   GGACGGCGGT CGGACTGCTC GGCAGCGGTC AGTGGCAAAG CCGCGCCGGC
601   AtTCGGGCAA AAACCCGTTT TGCTTTGCGT AACGGTGTCA ATCTTCAGCC
651   TTTTGCCGCT TTTAATGTtt TGCACAGGTC AAAATCTTTC GGCGTGGAAA
701   TGGACGGCGA AAAACAGACG CTGGCAGGCA GGACGGCACT CGAAGGGCGG
751   TTCGGTATTG AAGCCGGTTG GAAAGGCCAT ATGTCCGCA..
```

This corresponds to the amino acid sequence <SEQ ID 452; ORF35>:

```
  1 ..PCRRQGDDVY AAHASRQKLW LRFIGGRSHQ NIRGGAAADG WRKGVQIGGE

51 VFVRQNEGSX LAIGVMGGRA GQHASVNGKG GAAGSDLYGY GGGVYAAWHQ

101 LRDKQTGAYL DGWLQYQRFK HRINDENRAE RYKTKGWTAS VEGGYNALVA

151 EGIVGKGNNV RFYLQPQAQF TYLGVNGGFT DSEGTAVGLL GSGQWQSRAG

201 IRAKTRFALR NGVNLQPFAA FNVLHRSKSF GVEMDGEKQT LAGRTALEGR

251 FGIEAGWKGH MSA..
```

Computer analysis of this amino acid sequence gave the following results:

Homology with Putative Secreted VirG-Homologue of *N. meningitidis* (Accession Number A32247)

ORF and virg-h protein show 51% aa identity in 261aa overlap:

```
Orf35    5 QGDDVYAAHASRQKLWLRFIGGRSHQNIRGGAA-ADGWRKGVQIGGEVFVRQNEGSXLAI  63
             + D++      R+ LWLR I G S+Q ++G A  +G+RKGVQ+GGEVF  QNE + L+I
virg-h 396 KNSDIFDRTLPRKGLWLRVIDGHSNQWVQGKTAPVEGYRKGVQLGGEVFTWQNESNQLSI 455

Orf35   64 GVMGGRAGQHASVNGKG--GAAGSDLYGYGGGVYAAWHQLRDKQTGAYLDGWLQYQRFKH 121
             G+MGG+A Q ++ +          ++ G+G GVYA WHQL+DKQTGAY D W+QYQRF+H
virg-h 456 GLMGGQAEQRSTFHNPDTDNLTTGNVKGFGAGVYATWHQLQDKQTGAYADSWMQYQRFRH 515

Orf35  122 RINDENRAERYKTKGWTASVEGGYNALVAEGIVGKGNNVRFYLQPQAQFTYLGVNGGFTD 181
             RIN E+   ER+ +KG TAS+E GYNAL+AE    KGN++R YLQPQAQ TYLGVNG F+D
virg-h 516 RINTEDGTERFTSKGITASIEAGYNALLAEHFTKKGNSLRVYLQPQAQLTYLGVNGKFSD 575

Orf35  182 SEGTAVGLLGSGQWQSRAGIRAKTRFALRNGVNLQPFAAFNVLHRSKSFGVEMDGEKQTL 241
             SE   V LLGS Q Q+R G++AK +F+L    + ++PFAA N L+ +K FGVEMDGE++ +
virg-h 576 SENAHVNLLGSRQLQTRVGVQAKAQFSLYKNIAIEPFAAVNALYHNKPFGVEMDGERRVI 635

Orf35  242 AGRTALEGRFGIEAGWKGHMS                                        262
             +TA+E + G+    K H++
virg-h 636 NNKTAIESQLGVAVKIKSHLT                                        656
```

Homology with a Predicted ORF from *N. meningitidis* (Strain A)

ORF35 shows 96.9% identity over a 259aa overlap with an ORF (ORF35a) from strain A of *N. meningitidis*:

```
                                                  10        20        30
      orf35.pep                             PCRRQGDDVYAAHASRQKLWLRFIGGRSHQNIRG
                                            :|||||||  ||||||||||||||||||||||
      orf35a    QRLAIPEAEAVLYAQQAYAANTLFGLRAADRGDDVYAADPSRQKLWLRFIGGRSHQNIRG
                310       320       330       340       350       360

40        50        60        70        80        90
      orf35.pep  GAAADGWRKGVQIGGEVFVRQNEGSXLAIGVMGGRAGQHASVNGKGGAAGSDLYGYGGGV
                 ||||||  |||||||||||||||||| |||||||||||||||||||||||| :||||||
      orf35a    GAAADGRRKGVQIGGEVFVRQNEGSRLAIGVMGGRAGQHASVNGKGGAAGSYLHGYGGGV
                370       380       390       400       410       420

100       110       120       130       140       150
      orf35.pep  YAAWHQLRDKQTGAYLDGWLQYQRFKHRINDENRAERYKTKGWTASVEGGYNALVAEGIV
                 |||||||||||||||||||||||||| |||||||||||||||||||||||||||||:|
      orf35a    YAAWHQLRDKQTGAYLDGWLQYQRFKHIRNDENRAERYKTKGWTASVEGGYNALVAEGVV
                430       440       450       460       470       480

160       170       180       190       200       210
      orf35.pep  GKGNNVRFYLQPQAQFTYLGVNGGFTDSEGTAVGLLGSGQWQSRAGIRAKTRFALRNGVN
                 ||||||||||||||||||||||||||||||||||||||||||||||||||||||||||
      orf35a    GKGNNVRFYLQPQAQFTYLGVNGGFTDSEGTAVGLLGSGQWQSRAGIRAKTRFALRNGVN
                490       500       510       520       530       540
```

```
              220        230        240        250        260
orf35.pep    LQPFAAFNVLHRSKSFGVEMDGEKQTLAGRTALEGRFGIEAGWKGHMSA
             ||||||||||||||||||||||||||||||||||||||||||||||||
orf35a       LQPFAAFNVLHRSKSFGVEMDGEKQTLAGRTALEGRFGIEAGWKGHMSARIGYGKRTDGD
              550        560        570        580        590        600
orf35a       KEAALSLKWLFX
              610        620
```

The complete length ORF35a nucleotide sequence <SEQ ID 453> is:

```
   1 ATGTTCAGAG CTCAGCTTGG TTCAAATACT CGTTCTACCA AAATCGGCGA
  51 CGATGCCGAT TTTTCATTTT CAGACAAGCC GAAACCCGGC ACTTCCCATT
 101 ATTTTTCCAG CGGTAAAACC GATCAAAATT CATCCGAATA TGGGTATGAC
 151 GAAATCAATA TCCAAGGTAA AAACTACAAT AGCGGCATAC TCGCCGTCGA
 201 TAATATGCCC GTTGTTAAGA ATATATTAC AGATACTTAC GGGGATAATT
 251 TAAAGGATGC GGTTAAGAAG CAATTACAGG ATTTATACAA AACAAGACCC
 301 GAAGCTTGGG AAGAAAATAA AAAACGGACT GAGGAGGCGT ATATAGAACA
 351 GCTTGGACCA AAATTTAGTA TACTCAAACA GAAAAACCCC GATTTAATTA
 401 ATAAATTGGT AGAAGATTCC GTACTCACTC CTCATAGTAA TACATCACAG
 451 ACTAGTCTCA ACAACATCTT CAATAAAAAA TTACACGTCA AAATCGAAAA
 501 CAAATCCCAC GTCGCCGGAC AGGTGTTGGA ACTGACCAAG ATGACGCTGA
 551 AAGATTCCCT TGGGAACCG CGCCGCCATT CCGACATCCA TATGCTGGAA
 601 ACTTCCGATA TGCCCGCAT CCGCCTGAAC ACGAAAGATG AAAAACTGAC
 651 CGTCCATAAA GCGTATCAGG GCGGTGCGGA TTTTCCTGTT CGGCTACGACG
 701 TGCGGGAGTC GGACAAACCC GCCCTGACCT TTGAAGAAAA AGTCAGCGGA
 751 CAATCCGGCG TGGTTTTGGA ACGCCGGCCG GAAAATCTGA AAACGCTCGA
 801 CGGGCGCAAA CTGATTGCGG CGGAAAAGGC AGACTCTAAT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTCGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GCGGCGCAA AGGCGTGCAA ATCGGCGGCG
1151 AGGTGTTTGT ACGGCAAAAT GAAGGCAGCC GGCTGGCAAT CGGCGTGATG
1201 GGCGGCAGGG CTGGCCAGCA CGCATCAGTC AACGGCAAAG GCGGTGCGGC
1251 AGGCAGTTAT TTGCATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCGT TGTCGGAAAA GGCAATAATG TGCGGTTTTA CCTGCAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
```

```
1601 GCATTCGGGC AAAAACCCGT TTTGCTTTGC GTAACGGTGT CAATCTTCAG

1651 CCTTTTGCCG CTTTTAATGT TTTGCACAGG TCAAAATCTT TCGGCGTGGA

1701 AATGGACGGC GAAAAACAGA CGCTGGCAGG CAGGACGGCG CTCGAAGGGC

1751 GGTTCGGCAT TGAAGCCGGT TGGAAAGGCC ATATGTCCGC ACGCATCGGA

1801 TACGGCAAAA GGACGGACGG CGACAAAGAA GCCGCATTGT CGCTCAAATG

1851 GCTGTTTTGA
```

This encodes a protein having amino acid sequence <SEQ ID 454>:

```
  1 MFRAQLGSNT RSTKIGDDAD FSFSDKPKPG TSHYFSSGKT DQNSSEYGYD

51 EINIQGKNYN SGILAVDNMP VVKKYITDTY GDNLKDAVKK QLQDLYKTRP

101 EAWEENKKRT EEAYIEQLGP KFSILKQKNP DLINKLVEDS VLTPHSNTSQ

151 TSLNNIFNKK LHVKIENKSH VAGQVLELTK MTLKDSLWEP RRHSDIHMLE

201 TSDNARIRLN TKDEKLTVHK AYQGGADFLF GYDVRESDKP ALTFEEKVSG

251 QSGVVLERRP ENLKTLDGRK LIAAEKADSN SFAFKQNYRQ GLYELLLKQC

301 EGGFCLGVQR LAIPEAEAVL YAQQAYAANT LFGLRAADRG DDVYAADPSR

351 QKLWLRFIGG RSHQNIRGGA AADGRRKGVQ IGGEVFVRQN EGSRLAIGVM

401 GGRAGQHASV NGKGGAAGSY LHGYGGGVYA AWHQLRDKQT GAYLDGWLQY

451 QRFKHRINDE NRAERYKTKG WTASVEGGYN ALVAEGVVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
```

Homology with a Predicted ORF from *N. gonorrhoeae*

ORF35 shows 51.7% identity over a 261aa overlap with a predicted ORF (ORF35ngh) from *N. gonorrhoeae*:

```
orf35.pep                       PCRRQGDDVYAAHASRQKLWLRFIGGRSHQNIRG  34
                                :::|::    |: |||| | |:|:|  ::|
orf35ngh   FTKVQERDDIAIYAQQAQAANTLFALRLNDKNSDIFDRTLPRKGLWLRVIDGHSNQWVQG 370 orf35.pep  GAA-ADGWRKGVQIGGEVFVRQNEGSXLAIGVMGGRAGQHASVNGKG--GAAGSDLYGYG  91
           :|  ::|:|||||:||||: |||:: |:||:|||:| |:::    :   : ::: |:|
orf35ngh   KTAPVEGYRKGVQLGGEVFTWQNESNQLSIGLMGGQAEQRSTFRNPDTDNLTTGNVKGFG 430 orf35.pep  GGVYAAWHQLRDKQTGAYLDGWLQYQRFKHRINDENRAERYKTKGWTASVEGGYNALVAE 151
           :||||:||||:|||||||:|:|||||:|||:|||   :||:|| |||:||||||||:||
orf35ngh   AGVYATWHQLQDKQTGAYVDSWMQYQRFRHRINTEYATERFTSKGITASIEAGYNALLAE 490 orf35.pep  GIVGKGNNVRFYLQPQAQFTYLGVNGGFTDSEGTAVGLLGSGQWQSRAGIRAKTRFALRN 211
           ::: |||::| |||||:|||||||  |:|||:: |:|||  |||:|::|:::||:  |
orf35ngh   HFTKKGNSLRVYLQPQAQLTYLGVNGKFSDSENAQVNLLGSRQLQSRVGVQAKAQFAFTN 550 orf35.pep  GVNLQPFAAFNVLHRSKSFGVEMDGEKQTLAGRTALEGRFGIEAGWKGHMSA         263
           ||::|||:| |  :::| ||||:||:::  ::|:  ::|: |   |:|:::
orf35ngh   GVTFQPFVAVNSIYQQKPFGVEIDGDRRVINNKTVIETQLGVAAKIKSHLTLQASFNRQT 610
```

A partial ORF35ngh nucleotide sequence <SEQ ID 455> is predicted to encode a protein having partial amino acid sequence <SEQ ID 456>:

```
  1 ..KKLRDRNSEY WKEETYHIKS NGRTYPNIPA LFPKHPFDPF ENINNSKKIS
 51   FYDKEYTEDY LVGFARGFGV EKRNGEEEKP LRQYFKDCVN TENSNNDNCK
101   ISSFGNYGPI LIKSDIFALA SQIKNSHINS EILSVGNYIE WLRPTLNKLT
151   GWQEHLYAGL DPFHYIEVTD NSHVIGQTID LGALELTNSL WKPRWNSNID
201   YLITKNAEIR FNTKNESLLV KEDYAGGARF RFAYDLKDKV PEIPVLTFEK
251   NITGTSDIIF EGKALDNLKH LDGHQIVKVN DTADKDAFRL SSKYRKGIYT
301   LSLQQRPEGF FTKVQERDDI AIYAQQAQAA NTLFALRLND KNSDIFDRTL
351   PRKGLWLRVI DGHSNQWVQG KTAPVEGYRK GVQLGGEVFT WQNESNQLSI
401   GLMGGQAEQR STFRNPDTDN LTTGNVKGFG AGVYATWHQL QDKQTGAYVD
451   SWMQYQRFRH RINTEYATER FTSKGITASI EAGYNALLAE HFTKKGNSLR
501   VYLQPQAQLT YLGVNGKFSD SENAQVNLLG SRQLQSRVGV QAKAQFAFTN
551   GVTFQPFVAV NSIYQQKPFG VEIDGDRRVI NNKTVIETQL GVAAKIKSHL
601   TLQASFNRQT SKHHHAKQGA LNLQWTF*
```

Based on this prediction, these proteins from *N. meningitidis* and *N. gonorrhoeae*, and their epitopes, could be useful antigens for vaccines or diagnostics, or for raising antibodies.

Example 55

The following partial DNA sequence was identified in *N. meningitidis* <SEQ ID 457>:

```
  1..GCGGAATATG TTCAGTTCTC TATAGATTTG TTCAGTGTGG GTAAATCGGG
 51   GGGCGGTATA CCTAAGGCTA AGCCTGTGTT TGATGCGAAA CCGAGATGGG
101   AGGTTGATAG GAAGCTTAAT AAATTGACAA CTCGTGAGCA GGTGGAGAAA
151   AATGTTCAGG AAACGAGAAG AAGGAGTCAG AGTAGTCAGT TTAAAGCCCA
201   TGCGCAACGA GAATGGGAAA ATAAAACAGG GTTAGATTTT AATCATTTTA
251   TAGGTGGTGA TATCAATAAA AAAGGCACAG TAACAGGAGG GCATAGTCTA
301   ACCCGTGGTG ATGTACGGGT GATACAACAA ACCTCGGCAC CTGATAAACA
351   TGGGGT.TTA TCAAGCGACA GTGGAAATTN A
```

This corresponds to the amino acid sequence <SEQ ID 458; ORF46>:

```
  1..AEYVQFSIDL FSVGKSGGGI PKAKPVFDAK PRWEVDRKLN KLTTREQVEK
 51   NVQETRRRSQ SSQFKAHAQR EWENKTGLDF NHFIGGDINK KGTVTGGHSL
101   TRGDVRVIQQ TSAPDKHGXL SSDSGNX
```

Further work revealed further partial nucleotide sequence <SEQ ID 459>:

```
  1 ..GCAGTGTGCC TnCCGATGCA TGCACACGCC TCAnATTTGG CAAACGATTC
 51 TTTTATCCGG CAGGTTCTCG ACCGTCAGCA TTTCGAACCC GACGGGAAAT
101 ACCACCTATT CGGCAGCAGG GGGGAACTTG CCGAGCGCCA GTCTCATATC
151 GGATTGGGAA AAATACAAAG CCATCAGTTG GGCAACCTGA TGATTCAACA
201 GGCGGCCATT AAAGGAAATA TCGGCTACAT TGTCCGCTTT TCCGATCACG
251 GGCACGAAGT CCATTCCCCs TTCGACAACC ATGCCTCACA TTCCGATTCT
301 GATGAAGCCG GTAGTCCCGT TGACGGATTT AGCCTTTACC GCATCCATTG
351 GGACGGATAC GAACACCATC CCGCCGACGG CTATGACGGG CCACAGGGCG
401 GCGGCTATCC CGCTCCCAAA GGCGCGAGGG ATATATACAG TTACGACATA
451 AAAGGCGTTG CCCAAAATAT CCGCCTCAAC CTGACCGACA ACCGCAGCAC
501 CGGACAACGG CTTGCCGACC GTTTCCACAA TGCCGGTAGT ATGCTGACGC
551 AAGGAGTAGG CGACGGATTC AAACGCGCCA CCCGATACAG CCCCGAGCTG
601 GACAGATCGG GCAATGCCGC CGAAGCCTTC AACGGCACTG CAGATATCGT
651 TAAAAACATC ATCGGCGCTG CAGGAGAAAT TGT
```

This corresponds to the amino acid sequence <SEQ ID 460; ORF46-1>:

```
  1 ..AVCLPMHAHA SXLANDSFIR QVLDRQHFEP DGKYHLFGSR
     GELAERQSHI
 51 GLGKIQSHQL GNLMIQQAAI KGNIGYIVRF SDHGHEVHSP
     FDNHASHSDS
101 DEAGSPVDGF SLYRIHWDGY EHHPADGYDG PQGGGYPAPK
     GARDIYSYDI
151 KGVAQNIRLN LTDNRSTGQR LADRFHNAGS MLTQGVGDGF
     KRATRYSPEL
201 DRSGNAAEAF NGTADIVKNI IGAAGEI
```

Computer analysis of this amino acid sequence gave the following results:

Homology with a Predicted ORF from *N. gonorrhoeae*

ORF46 shows 98.2% identity over a 111 aa overlap with a predicted ORF (ORF46ng) from *N. gonorrhoeae*:

```
orf46.pep            AEYVQFSIDLFSVGKSGGGIPKAKPVFDAKPRWEVDRKLNKLTTR  45
                     |||||||||||||||||||||||||||||||||||||||||||||
orf46ng   PKTGVPFDGKGFPNFEKHVKYDTKLDIQELSGGGIPKAKPVFDAKPRWEVDRKLNKLTTR 217 orf46.pep EQVEKNVQETRRRSQSSQFKAHAQREWENKTGLDFNHFIGGDINKKGTVTGGHSLTRGDV 105
          |||||||||||||||||||||||||||||||||||||||||||||:||||||||||||
orf46ng   EQVEKNVQETRRRSQSSQFKAHAQREWENKTGLDFNHFIGGDINKKGAVTGGHSLTRGDV 277 orf46.pep RVIQQTSAPDKHGXLSSDSGN 126
          ||||||||||||||| |||||||
orf46ng   RVIQQTSAPDKHGVLSSDSGN 298
```

A partial ORF46ng nucleotide sequence <SEQ ID 461> is predicted to encode a protein having partial amino acid sequence <SEQ ID 462>:

```
  1 ..RRLKHCCHAR LGSAFHRKQD GAHQRFGRYG ATQRLCRSSH PRLGSPKPQC
 51 RTRHRSRQQY LYGSHPHQRD WSCPGKIQLG RHHGTSCRAV ADXRDRICER
101 EIRRQRQXCR CRLGKIPSLS IPKYPLKLEQ RYGKENITSS TVPPSNGKNV
151 KLADQRHPKT GVPFDGKGFP NFEKHVKYDT KLDIQELSGG GIPKAKPVFD
201 AKPRWEVDRK LNKLTTREQV EKNVQETRRR SQSSQFKAHA QREWENKTGL
251 DFNHFIGGDI NKKGAVTGGH SLTRGDVRVI QQTSAPDKHG VLSSDSGN*
```

Further work revealed the complete gonococcal DNA sequence <SEQ ID 463>:

```
   1 TTGGGCATTT CCCGCAAAAT ATCCCTTATT CTGTCCATAC TGGCAGTGTG
  51 CCTGCCGATG CATGCACACG CCTCAGATTT GGcaAACGAT CCCTTTATCC
 101 GgCaggttcT CGaccGTCAG CATTTCGaac ccgacggGAa ATACCaCCTA
 151 TTcggCaGCA GGGGGGAGCT TgccnagcGC aacggccATa tcggattggG
 201 aaacaTAcaa Agccatcagt tGggccacct gatgattcaa caggcggccg
 251 ttgaaggaaA TAtcgGctac attgtccgct tttccgatca cgggcacaaa
 301 ttccattcgc ccttcGAcaa ccaTGCCTCA CATTCCGATT CTGACGAAGC
 351 CGGTAGTCCC GTTGACGGAT TCAGCCTTTA CCGCATCCAT TGGGACGGAT
 401 ACGAACACCA TCCCGCCGAC GGCTATGACG GGCCACAGGG CGGCGGCTAT
 451 CCCGCTCCCA AAGGCGCGAG GOATATATAC AGCTACGACA TAAAAGGCGT
 501 TGCCCAAAAT ATCCGCCTCA ACCTGACCGA CAACCGCAGC ACCGGACAAC
 551 GGCTTGCCGA CCGTTTCCAC AATGCCGGCG CTATGCTGAC GCAAGGAGTA
 601 GGCGACGGAT TCAAACGCGC CACCCGATAC AGCCCCGAGC TGGACAGATC
 651 GGGCAATGCc gccGAAGCCT TCAACGGCAC TGCAGATATC GTCAAAAACA
 701 TCATCGGCGC GGCAGGAGAA ATTGTCGGCG CAGGCGATGC CGTGCagGGT
 751 ATAAGCGAAG GCTCAAACAT TGCTGTCATG CACGGCTTGG GTCTGCTTTC
 801 CACCGAAAAC AAGATGGCGC GCATCAACGA TTTGGCAGAT ATGGCGCAAC
 851 TCAAAGACTA TGCCGCAGCA GCCATCCGCG ATTGGGCAGT CCAAAACCCC
 901 AATGCCGCAC AAGGCATAGA AGCCGTCAGC AATATCTTTA TGGCAGCCAT
 951 CCCCATCAAA GGGATTGGAG CTGTCCGGGG AAAATACGGC TTGGGCGGCA
1001 TCACGGCACA TCCTGTCAAG CGGTCGCAGA TGGGCGCGAT CGCATTGCCG
1051 AAAGGGAAAT CCGCCGTCAG CGACAATTTT GCCGATGCGG CATACGCCAA
1101 ATACCCGTCC CCTTACCATT CCCGAAATAT CCGTTCAAAC TTGGAGCAGC
1151 GTTACGGCAA AGAAACATC ACCTCCTCAA CCGTGCCGCC GTCAAACGGC
1201 AAAAATGTCA AACTGGCAGA CCAACGCCAC CCGAAGACAG GCGTACCGTT
1251 TGACGGTAAA GGGTTTCCGA ATTTTGAGAA GCACGTGAAA TATGATACGA
1301 AGCTCGATAT TCAAGAATTA TCGGGGGGCG GTATACCTAA GGCTAAGCCT
1351 GTGTTTGATG CGAAACCGAG ATGGGAGGTT GATAGGAAGC TTAATAAATT
1401 GACAACTCGT GAGCAGGTGG AGAAAAATGT TCAGGAAACG AGAAGAAGGA
1451 GTCAGAGTAG TCAGTTTAAA GCCCATGCGC AACGAGAATG GGAAAATAAA
1501 ACAGGGTTAG ATTTTAATCA TTTTATAGGT GGTGATATCA ATAAGAAAGG
1551 CACAGTAACA GGAGGGCATA GTCTAACCCG TGGTGATGTA CGGGTGATAC
1601 AACAAACCTC GGCACCTGAT AAACATGGGG TTTATCAAGC GACAGTGGAA
1651 ATTAAAAAGC CTGATGGAAG TTGGGAGGTG AAAACGAAAA AAGGTGGGAA
1701 AGTGATGACC AAGCACACCA TGTTCCCAAA AGATTGGGAT GAGGCTAGAA
1751 TTAGGGCTGA AGTTACTTCG GCTTGGGAAA GTAGAATAAT GCTTAAGGAT
1801 AATAAATGGC AGGGTACAAG TAAATCGGGT ATTAAAATAG AAGGATTTAC
1851 CGAACCTAAT AGAACAGCAT ATCCCATTTA TGAATAG
```

This corresponds to the amino acid sequence <SEQ ID 464; ORF46ng-1>:

```
  1 LGISRKISLI LSILAVCLPM HAHASDLAND PFIRQVLDRQ HFEPDGKYHL

51 FGSRGELAXR NGHIGLGNIQ SHQLGHLMIQ QAAVEGNIGY IVRFSDHGHK

101 FHSPFDNHAS HSDSDEAGSP VDGFSLYRIH WDGYEHHPAD GYDGPQGGGY

151 PAPKGARDIY SYDIKGVAQN IRLNLTDNRS TGQRLADRFH NAGAMLTQGV

201 GDGFKRATRY SPELDRSGNA AEAFNGTADI VKNIIGAAGE IVGAGDAVQG

251 ISEGSNIAVM HGLGLLSTEN KMARINDLAD MAQLKDYAAA AIRDWAVQNP

301 NAAQGIEAVS NIFMAAIPIK GIGAVRGKYG LGGITAHPVK RSQMGAIALP

351 KGKSAVSDNF ADAAYAKYPS PYHSRNIRSN LEQRYGKENI TSSTVPPSNG

401 KNVKLADQRH PKTGVPFDGK GFPNFEKHVK YDTKLDIQEL SGGGIPKAKP

451 VFDAKPRWEV DRKLNKLTTR EQVEKNVQET RRRSQSSQFK AHAQREWENK

501 TGLDFNHFIG GDINKKGTVT GGHSLTRGDV RVIQQTSAPD KHGVYQATVE

551 IKKPDGSWEV KTKKGGKVMT KHTMFPKDWD EARIRAEVTS AWESRIMLKD

601 NKWQGTSKSG IKIEGFTEPN RTAYPIYE*
```

ORF46ng-1 and ORF46-1 show 94.7% identity in 227 aa overlap:

```
                       10         20         30         40
    orf46-1.pep        AVCLPMHAHASXLANDSFIRQVLDRQHFEPDGKYHLFGSRGELAER
                       |||||||||||| |||| |||||||||||||||||||||||||| |
    orf46ng-1   LGISRKISLILSILAVCLPMHAHASDLANDPFIRQVLDRQHFEPDGKYHLFGSRGELAXR
                       10        20        30        40        50        60

50         60         70         80         90        100
    orf46-1.pep QSHIGLGKIQSHQLGNLMIQQAAIKGNIGYIVRFSDHGHEVHSPFDNHASHSDSDEAGSP
                ::|||||:|||||||:|||||||:|||||||||||||||:|||||||||||||||||||
    orf46ng-1   NGHIGLGNIQSHQLGHLMIQQAAVEGNIGYIVRFSDHGHKFHSPFDNHASHSDSDEAGSP
                       70        80        90       100       110       120

110       120       130       140       150       160
    orf46-1.pep VDGFSLYRIHWDGYEHHPADGYDGPQGGGYPAPKGARDIYSYDIKGVAQNIRLNLTDNRS
                ||||||||||||||||||||||||||||||||||||||||||||||||||||||||||||
    orf46ng-1   VDGFSLYRIHWDGYEHHPADGYDGPQGGGYPAPKGARDIYSYDIKGVAQNIRLNLTDNRS
                       130       140       150       160       170       180

170       180       190       200       210       220
    orf46-1.pep TGQRLADRFHNAGSMLTQGVGDGFKRATRYSPELDRSGNAAEAFNGTADIVKNIIGAAGE
                |||||||||||||:||||||||||||||||||||||||||:|||||||||||||||||||
    orf46ng-1   TGQRLADRFHNAGAMLTQGVGDGFKRATRYSPELDRSGNAAEAFNGTADIVKNIIGAAGE
                       190       200       210       220       230       240 orf46-1.pep I
                |
    orf46ng-1   IVGAGDAVQGISEGSNIAVMHGLGLLSTENKMARINDLADMAQLKDYAAAAIRDWAVQNP
                       250       260       270       280       290       300
```

Homology with a Predicted ORF from *N. meningitidis* (Strain A)

ORF46ng-1 shows 87.4% identity over a 486aa overlap with an ORF (ORF46a) from strain A of *N. meningitidis*:

```
                       10        20        30        40        50        60
    orf46a.pep  LGISRKISLILSILAVCLPMHAHASDLANDSFIRQVLDRQHFEPDGKYHLFGSRGELAER
                ||||||||||||||||||||||||||||||| ||||||||||||||||||||||||||| |
    orf46ng-1   LGISRKISLILSILAVCLPMHAHASDLANDPFIRQVLDRQHFEPDGKYHLFGSRGELAXR
                       10        20        30        40        50        60

70        80        90       100       110       120
    orf46a.pep  SGHIGLGNIQSHQLGNLFIQQAAIKGNIGYIVRFSDHGHEVHSPFDNHASHSDSDEAGSP
                :||||||||||||||:|:||||||:|||||||||||||||:|||||||||||||||||||
    orf46ng-1   NGHIGLGNIQSHQLGHLMIQQAAVEGNIGYIVRFSDHGHKFHSPFDNHASHSDSDEAGSP
                       70        80        90       100       110       120
```

```
                       130       140       150       160       170       180
orf46a.pep    VDGFSLYRIHWDGYEHHPADGYDGPQGGGYPAPKGARDIYSYDIKGVAQNIRLNLTDNRS
              ||||||||||||||||||||||||||||||||||||||||||||||||||||||||||||
orf46ng-1     VDGFSLYRIHWDGYEHHPADGYDGPQGGGYPAPKGARDIYSYDIKGVAQNIRLNLTDNRS
                       130       140       150       160       170       180

190       200       210       220       230       240
orf46a.pep    TGQRLVDRFHNTGSMLTQGVGDGFKRATRYSPELDRSGNAAEAFNGTADIVKNIIGAAGE
              |||||:||||||:|:|||||||||||||||||||||||||||||||||||||||||||||
orf46ng-1     TGQRLADRFHNAGAMLTQGVGDGFKRATRYSPELDRSGNAAEAFNGTADIVKNIIGAAGE
                       190       200       210       220       230       240

250       260       270       280       290       300
orf46a.pep    IVGAGDAVQGISEGSNIAVMHGLGLLSTENKMARINDLADMAQLKDYAAAAIRDWAVQNP
              ||||||||||||||||||||||||||||||||||||||||||||||||||||||||||||
orf46ng-1     IVGAGDAVQGISEGSNIAVMHGLGLLSTENKMARINDLADMAQLKDYAAAAIRDWAVQNP
                       250       260       270       280       290       300

310       320       330       340       350       360
orf46a.pep    NAAQGIEAVSNIFTAVIPVKGIGAVRGKYGLGGITAHPVKRSQMGEIALPKGKSAVSDNF
              ||||||||||||:||:||||:|||||||||||||||||||||||||||:||||||||||
orf46ng-1     NAAQGIEAVSNIFMAAIPIKGIGAVRGKYGLGGITAHPVKRSQMGAIALPKGKSAVSDNF
                       310       320       330       340       350       360

370       380       390       400       410       420
orf46a.pep    ADAAYAKYPSPYHSRNIRSNLEQRYGKENITSSTVPPSNGKNVKLANKRHPKTKVPFDGK
              |||||||||||||||||||||||||||||||||||||||||||||::||||  ||||||
orf46ng-1     ADAAYAKYPSPYHSRNIRSNLEQRYGKENITSSTVPPSNGKNVKLADQRHPKTGVPFDGK
                       370       380       390       400       410       420

430       440       450       460       470
orf46a.pep    GFPNFEKDVKYDTRINTAVPQVN----PIDEPVFN--PKGSVGSAHSWSITARIQYAKLP
              |||||||:||||:::  :  :::   |  :|||:  |:    |    :|:|  |
orf46ng-1     GFPNFEKHVKYDTKLD--IQELSGGGIPKAKPVFDAKPRWEVDRKLN-KLTTREQVEKNV
                       430       440       450       460       470

480       490       500       510       520       530
orf46a.pep    RQGRIRYIPPKNYSPSAPLPKGPNNGYLDKFGNEWTKGPSRTKGQEFEWDVQLSKTGREQ
              ::  |   |
orf46ng-1     QETRRRSQSSQFKAHAQREWENKTGLDFNHFIGGDINKKGTVTGGHSLTRGDVRVIQQTS
                       480       490       500       510       520       530
```

The complete length ORF46a DNA sequence <SEQ ID 465> is:

```
  1 TTGGGCATTT CCCGCAAAAT ATCCCTTATT CTGTCCATAC TGGCAGTGTG

51 CCTGCCGATG CATGCACACG CCTCAGATTT GGCAAACGAT TCTTTTATCC

101 GGCAGGTTCT CGACCGTCAG CATTTCGAAC CCGACGGGAA ATACCACCTA

151 TTCGGCAGCA GGGGGGAACT TGCCGAGCGC AGCGGTCATA TCGGATTGGG

201 AAACATACAA AGCCATCAGT TGGGCAACCT GTTCATCCAG CAGGCGGCCA

251 TTAAAGGAAA TATCGGCTAC ATTGTCCGCT TTTCCGATCA CGGGCACGAA

301 GTCCATTCCC CCTTCGACAA CCATGCCTCA CATTCCGATT CTGATGAAGC

351 CGGTAGTCCC GTTGACGGAT TCAGCCTTTA CCGCATCCAT TGGGACGGAT

401 ACGAACACCA TCCCGCCGAC GGCTATGACG GGCCACAGGG CGGCGGCTAT

451 CCCGCTCCCA AAGGCGCGAG GGATATATAC AGCTACGACA TAAAAGGCGT

501 TGCCCAAAAT ATCCGCCTCA ACCTGACCGA CAACCGCAGC ACCGGACAAC

551 GGCTTGTCGA CCGTTTCCAC AATACCGGTA GTATGCTGAC GCAAGGAGTA

601 GGCGACGGAT TCAAACGCGC CACCCGATAC AGCCCCGAGC TGGACAGATC

651 GGGCAATGCC GCCGAAGCTT TCAACGGCAC TGCAGATATC GTCAAAAACA

701 TCATCGGCGC GGCAGGAGAA ATTGTCGGCG CAGGCGATGC CGTGCAGGGT

751 ATAAGCGAAG GCTCAAACAT TGCTGTTATG CACGGCTTGG GTCTGCTTTC

801 CACCGAAAAC AAGATGGCGC GCATCAACGA TTTGGCAGAT ATGGCGCAAC

851 TCAAAGACTA TGCCGCAGCA GCCATCCGCG ATTGGGCAGT CCAAAACCCC

901 AATGCCGCAC AAGGCATAGA AGCCGTCAGC AATATCTTTA CGGCAGTCAT
```

```
-continued
 951 CCCCGTCAAA GGGATTGGAG CTGTTCGGGG AAAATACGGC TTGGGCGGCA

1001 TCACGGCACA TCCTGTCAAG CGGTCGCAGA TGGGCGAGAT CGCATTGCCG

1051 AAAGGGAAAT CCGCCGTCAG CGACAATTTT GCCGATGCGG CATACGCCAA

1101 ATACCCGTCC CCTTACCATT CCCGAAATAT CCGTTCAAAC TTGGAGCAGC

1151 GTTACGGCAA AGAAAACATC ACCTCCTCAA CCGTGCCGCC GTCAAACGGA

1201 AAGAATGTGA AACTGGCAAA CAAACGCCAC CCGAAGACCA AAGTGCCGTT

1251 TGACGGTAAA GGGTTTCCGA ATTTTGAAAA AGACGTAAAA TACGATACGA

1301 GAATTAATAC CGCTGTACCA CAAGTGAATC CTATAGATGA ACCCGTCTTT

1351 AATCCTAAAG GTTCTGTCGG ATCGGCTCAT TCTTGGTCTA TAACTGCCAG

1401 AATTCAATAC GCAAAATTAC CAAGGCAAGG TAGAATCAGA TATATCCCAC

1451 CTAAAAATTA CTCTCCTTCA GCACCGCTAC CAAAAGGACC TAATAATGGA

1501 TATTTGGATA AATTTGGTAA TGAATGGACT AAAGGTCCAT CAAGAACTAA

1551 AGGTCAAGAA TTTGAATGGG ATGTTCAATT GTCTAAAACA GGAAGAGAGC

1601 AACTTGGATG GGCTAGTAGG GATGGTAAGC ATTTAAATAT ATCAATTGAT

1651 GGAAAGATTA CACACAAATG A
```

This corresponds to the amino acid sequence <SEQ ID 466>:

```
  1 LGISRKISLI LSILAVCLPM HAHASDLAND SFIRQVLDRQ HFEPDGKYHL

51 FGSRGELAER SGHIGLGNIQ SHQLGNLFIQ QAAIKGNIGY IVRFSDHGHE

101 VHSPFDNHAS HSDSDEAGSP VDGFSLYRIH WDGYEHHPAD GYDGPQGGGY

151 PAPKGARDIY SYDIKGVAQN IRLNLTDNRS TGQRLVDRFH NTGSMLTQGV

201 GDGFKRATRY SPELDRSGNA AEAFNGTADI VKNIIGAAGE IVGAGDAVQG

251 ISEGSNIAVM HGLGLLSTEN KMARINDLAD MAQLKDYAAA AIRDWAVQNP

301 NAAQGIEAVS NIFTAVIPVK GIGAVRGKYG LGGITAHPVK RSQMGEIALP

351 KGKSAVSDNF ADAAYAKYPS PYHSRNIRSN LEQRYGKENI TSSTVPPSNG

401 KNVKLANKRH PKTKVPFDGK GFPNFEKDVK YDTRINTAVP QVNPIDEPVF

451 NPKGSVGSAH SWSITARIQY AKLPRQGRIR YIPPKNYSFS APLPKGPNNG

501 YLDKFGNEWT KGPSRTKGQE FEWDVQLSKT GREQLGWASR DGKHLNISID

551 GKITHK*
```

Based on this analysis, including the presence of a RGD sequence in the gonococcal protein, typical of adhesins, it is predicted that the proteins from *N. meningitidis* and *N. gonorrhoeae*, and their epitopes, could be useful antigens for vaccines or diagnostics, or for raising antibodies.

Example 56

The following partial DNA sequence was identified in *N. meningitidis* <SEQ ID 467>:

```
  1 ATGAATATTC ACACCCTGCT CTCCAAACAA TGGACGCTGC CGCCATTCCT

51 GCCGAAACGG CTGCTGCTGT CCCTGCTGAT ACTGCTTGCC CCCAATGCGG
```

-continued

```
101 TGTTTTGGGT TTTGGCACTG CTGACCGCCA CCGCCCGCCC GATTGTCAAT

151 TTGGACTATC TTCCCGCCGC GCTGCTGATC GCCCTGCCTT GGCGTTTCGT

201 CAAAATTGCC GGCGTATTGG CGTTTTGGCT GGCGGTTTTG TTTGACGGGC

251 TGATGATGGT GATCCAACTC TTCCCTTTTA TGGATCTCAT CGGCGCCATC

301 AACCTCGTCC CCTTCATCCT GACCGCCCCC GCCCCTTATC AGATAATGAC

351 CGGGCTG...
```

This corresponds to the amino acid sequence <SEQ ID 468; ORF48>:

```
  1 MNIHTLLSKQ WTLPPFLPKR LLLSLLILLA PNAVFWVLAL LTATARPIVN

51 LDYLPAALLI ALPWRFVKIA GVLAFWLAVL FDGLMMVIQL FPFMDLIGAI

101 NLVPFILTAP APYQIMTGL...
```

Further work revealed the complete nucleotide sequence <SEQ ID 469>:

```
   1 ATGAATATTC ACACCCTGCT CTCCAAACAA TGGACGCTGC CGCCATTCCT

51 GCCGAAACGG CTGCTGCTGT CCCTGCTGAT ACTGCTTGCC CCCAATGCGG

101 TGTTTTGGGT TTTGGCACTG CTGACCGCCA CCGCCCGCCC GATTGTCAAT

151 TTGGACTATC TTCCCGCCGC GCTGCTGATC GCCCTGCCTT GGCGTTTCGT

201 CAAAATTGCC GGCGTATTGG CGTTTTGGCT GGCGGTTTTG TTTGACGGGC

251 TGATGATGGT GATCCAACTC TTCCCTTTTA TGGATCTCAT CGGCGCCATC

301 AACCTCGTCC CCTTCATCCT CACCGCCCCC GCCCCTTATC AGATAATGAC

351 CGGGCTGTTG CTGCTGTATA TGCTGGCGAT GCCGTTTGTG TTGCAGAAAG

401 CCGCCGCCAA AACCGACTTC CGGCACATTG CCGTCTGCGC CGCCGTTGTG

451 GCGGCAGCCG GCTATTTCAC CGGCCATTTG AGTTACTACG ACCGGGGTCG

501 GATGGCCAAT ATCTTCGGCG CAAACAACTT CTACTACGCC AAAAGTCAGG

551 CGATGCTCTA CACCGTCAGC CAGAATGCCG ACTTTATTAC CGCCGGCCTG

601 GTCGATCCCG TCTTCCTCCC CTTGGGCAAT CAACAGCGTG CCGCCACGCA

651 TCTGAACGAG CCGAAATCTC AAAAAATCCT CTTTATCGTC GCCGAATCTT

701 GGGGGCTGCC GGCCAATCCC GAACTTCAAA ACGCCACTTT TGCCAAACTG

751 CTGGCGCAAA AAGACCGTTT TTCGGTTTGG GAAAGCGGCA GTTTTCCCTT

801 CATCGGCGCG ACGGTCGAAG GCGAAATGCG CGAACTGTGT GCCTACGGCG

851 GTTTGCGCGG GTTCGCACTG CGCCGCGCGC CCGACGAAAA ATTTGCCCGC

901 TGCCTCCCCA ACCGTTTGAA ACAAGAAGGT TACGCCACCT TTGCGATGCA

951 CGGCGCGGGC AGTTCGCTTT ACGACCGCTT CAGCTGGTAT CCGAGGGCGG

1001 GCTTTCAAGA AATCAAAACC GCCGAAAACC TGATCGGTAA AAAACCTGC

1051 GCCATTTTCG GCGGCGTGTG CGACAGCGAG CTGTTCGGCG AAGTGTCGGC

1101 ATTTTTCAAA AAACACGACA AGGGACTGTT TTACTGGATG ACGCTGACCA

1151 GCCACGCCGA CTATCCCGAA TCCGACATTT TCAACCACAG GCTCAAATGC
```

-continued

```
1201 ACCGAATATG GCCTGCCCGC CGAAACCGAC CTCTGCCGCA ATTTCAGCCT

1251 GCACACCCAA TTCTTCGACC AACTGGCGGA TTTGATCCAA CGCCCCGAAA

1301 TGAAAGGCAC GGAAGTCATC ATCGTCGGCG ACCATCCGCC GCCCGTCGGC

1351 AACCTCAATG AAACCTTCCG CTACCTCAAA CAGGGGCACG TCGCCTGGCT

1401 GAACTTCAAA ATCAAATAA
```

This corresponds to the amino acid sequence <SEQ ID 470; ORF48-1>:

```
  1 MNIHTLLSKQ WTLPPFLPKR LLLSLLILLA PNAVFWVLAL LTATARPIVN

51 LDYLPAALLI ALPWRFVKIA GVLAFWLAVL FDGLMMVIQL FPFMDLIGAI

101 NLVPFILTAP APYQIMTGLL LLYMLAMPFV LQKAAAKTDF RHIAVCAAVV

151 AAAGYFTGHL SYYDRGRMAN IFGANNFYYA KSQAMLYTVS QNADFITAGL

201 VDPVFLPLGN QQRAATHLNE PKSQKILFIV AESWGLPANP ELQNATFAKL

251 LAQKDRFSVW ESGSFPFIGA TVEGEMRELC AYGGLRGFAL RRAPDEKFAR

301 CLPNRLKQEG YATFAMHGAG SSLYDRFSWY PRAGFQEIKT AENLIGKKTC

351 AIFGGVCDSE LFGEVSAFFK KHDKGLFYWM TLTSHADYPE SDIFNHRLKC

401 TEYGLPAETD LCRNFSLHTQ FFDQLADLIQ RPEMKGTEVI IVGDHPPPVG

451 NLNETFRYLK QGHVAWLNFK IK*
```

Computer analysis of this amino acid sequence gave the following results:

Homology with a Predicted ORF from *N. meningitidis* (Strain A)

ORF48 shows 94.1% identity over a 119aa overlap with an ORF (ORF48a) from strain A of *N. meningitidis*:

```
                    10         20         30         40         50         60
    orf48.pep  MNIHTLLSKQWTLPPFLPKRLLLSLLILLAPNAVFWVLALLTATARPIVNLDYLPAALLI
               ||||||||||||||||||||||||||||| ||||||||||||||||||| |||||||||
    orf48a     MNIHTLLSKQWTLPPFLPKRLLLSLLILLXPNAVFWVLALLTATARPIVNLXYLPAALLI
                    10         20         30         40         50         60

70         80         90        100        110        119
    orf48.pep  ALPWRFVKIAGVLAFWLAVLFDGLMMVIQLFPFMDLIGAINLVPFILTAPAPYQIMTGL
               ||||| ||| |||| |||||||||||||||||||||||||||||||| ||| ||||||
    orf48a     ALPWRXVKIXGVLAXWLAVLFDGLMMVIQLFPFMDLIGAINLVPFIXTAPALYQIMTGLL
                    70         80         90        100        110        120 orf48a     LLYMLAMPFVLQKAAAKTDFRHIAACAAVVVAAGYFTGHLSXYDRGRMANIFGANNFYYA
                   130        140        150        160        170        180
```

The complete length ORF48a nucleotide sequence <SEQ ID 471> is:

```
  1 ATGAATATTC ACACCCTGCT CTCCAAACAA TGGACGCTGC CGCCATTCCT

51 GCCGAAACGG CTGCTGCTGT CCCTGCTGAT ACTGCTNNCC CCCAATGCGG

101 TGTTTTGGGT TTTGGCACTG CTGACCGCCA CCGCCCGCCC GATTGTCAAT

151 TTGGANTACC TTCCCGCCGC GCTGCTGATC GCCCTGCCTT GGCGTNTCGT

201 CAAAATTGNC GGCGTATTGG CGTNTTGGCT GGCGGTTTTG TTTGACGGGC

251 TGATGATGGT GATCCAACTC TTCCCTTTTA TGGATCTCAT CGGCGCCATC
```

-continued

```
 301 AACCTCGTCC CCTTCATCNT GACCGCCCCC GCCCTTTATC AGATAATGAC
 351 CGGGCTGTTA CTGCTGTATA TGCTGGCGAT GCCGTTTGTG TTGCAGAAAG
 401 CCGCCGCCAA AACCGACTTC CGACACATTG CCGCCTGTGC CGCCGTTGTG
 451 GTGGCAGCCG GCTATTTTAC CGGCCATTTG AGTTANTACG ACCGGGGGCG
 501 GATGGCCAAT ATCTTCGGCG CAAACAACTT CTATTACGCC AAAAGTCAGG
 551 CGATGCTCTA CACCGTCAGC CAGAATGCCG ACTTTATTAC CGCCGGCCTG
 601 GTCGATCCCG TCTTCCTCCC CTTGGGCAAT CAACAGCGTG CCGCCACGCA
 651 TCTGAACGAG CCGAAATCTC AAAAAATCCT CTTTATCGTC GCCGAATCTT
 701 GGGGGCTGCC GGCCAATCCC GAACTTCAAA ACGCCACTTT TGCCAAACTG
 751 CTGGCGCAAA AAGANCGTTT TTCGGTTTGG GAAAGCGGCA GTTTTCCCTT
 801 CATCGGCGCG ACGATCGAAG GCGAAATGCG CGAACTGTGT GCCTACGGCG
 851 GTTTGCGCGG GTTCGCACTG CGCCGCGCGC CCGACGAAAA ATTTGCCCGC
 901 TGCCTCCCCA ACCGTTTGAA ACAAGAAGGT TACGCCACCT TTGCGATGCA
 951 CGGCGCGGGC AGTTCGCTTT ACGACCGCTT CAGCTGGTAT CCGAGGGCGG
1001 GCTTTCAAGA AATCAAAACC GCCGAAAACC TGATCGGTAA AAAAACCTGC
1051 GCCATTTTCG GCGGCGTGTG CGACAGCGAG CTGTTCGGCG AAGTGTCGGC
1101 ANTTTTCAAA AAACACGACA AGGGACTGTT TTACTGGATG ACGCTGACCA
1151 GCCACGCCGA CTATCCCGAA TCNGACATTT TCAACCACAG GCTCAAATGC
1201 ACCGAATATG GCCTGCCCGC CGAAACCGAC NTCTGCCGCA ATTTCAGCCT
1251 GCACACCCAA TTCTTCGACC AACTGGCGGA TTTGATCCAA CGCCCCGAAA
1301 TGAAAGGCAC GCAAGTCATC ATCGTCGGCG ACCATCCGCC GCCCGTCGGC
1351 AACCTCAATG AAACCTTCCG CTACCTCAAA CAGGGGCACG TCGNCTGGCT
1401 GAACTTCAAA ATCAAATAA
```

This encodes a protein having amino acid sequence <SEQ ID 472>:

```
  1 MNIHTLLSKQ WTLPPFLPKR LLLSLLILLX PNAVFWVLAL LTATARPIVN

51 LXYLPAALLI ALPWRXVKIX GVLAXWLAVL FDGLMMVIQL FPFMDLIGAI

101 NLVPFIXTAP ALYQIMTGLL LLYMLAMPFV LQKAAAKTDF RHIAACAAVV

151 VAAGYFTGHL SXYDRGRMAN IFGANNFYYA KSQAMLYTVS QNADFITAGL

201 VDPVFLPLGN QQRAATHLNE FKSQKILFIV AESWGLPANP ELQNATFAKL

251 LAQKXRFSVW ESGSFPFIGA TIEGEMRELC AYGGLRGFAL RRAPDEKFAR

301 CLPNRLKQEG YATFAMHGAG SSLYDRFSWY PRAGFQEIKT AENLIGKKTC

351 AIFGGVCDSE LFGEVSAXFK KHDKGLFYWM TLTSHADYPE SDIFNHRLKC

401 TEYGLPAETD XCRNFSLHTQ FFDQLADLIQ RPEMKGTEVI IVGDHPPPVG

451 NLNETFRYLK QGHVXWLNFK IK*
```

ORF48a and ORF48-1 show 96.8% identity in 472 aa overlap:

```
                  10        20        30        40        50        60
orf48a.pep  MNIHTLLSKQWTLPPFLPKRLLLSLLILLXPNAVFWVLALLTATARPIVNLXYLPAALLI
            |||||||||||||||||||||||||||| |||||||||||||||||||||| ||||||||
orf48-1     MNIHTLLSKQWTLPPFLPKRLLLSLLILLAPNAVFWVLALLTATARPIVNLDYLPAALLI
                  10        20        30        40        50        60

70        80        90       100       110       120
orf48a.pep  ALPWRXVKIXGVLAXWLAVLFDGLMMVIQLFPPFMDLIGAINLVPFIXTAPALYQIMTGLL
            |||||  ||| |||| |||||||||||||||||||||||||||||||| ||||| ||||||
orf48-1     ALPWRFVKIAGVLAFWLAVLFDGLMMVIQLFPPFMDLIGAINLVPFILTAPAPYQIMTGLL
                  70        80        90       100       110       120

130       140       150       160       170       180
orf48a.pep  LLYMLAMPFVLQKAAAKTDFRHIAACAAVVVAAGYFTGHLSXYDRGRMANIFGANNFYYA
            |||||||||||||||||||||||||||:|||||:|||||||||| |||||||||||||||
orf48-1     LLYMLAMPFVLQKAAAKTDFRHIAVCAAVVAAAGYFTGHLSYYDRGRMANIFGANNFYYA
                 130       140       150       160       170       180

190       200       210       220       230       240
orf48a.pep  KSQAMLYTVSQNADFITAGLVDPVFLPLGNQQRAATHLNEPKSQKILFIVAESWGLPANP
            |||||||||||||||||||||||||||||||||||||||||||||||||||||||||||
orf48-1     KSQAMLYTVSQNADFITAGLVDPVFLPLGNQQRAATHLNEPKSQKILFIVAESWGLPANP
                 190       200       210       220       230       240

250       260       270       280       290       300
orf48a.pep  ELQNATFAKLLAQKXRFSVWESGSFPFIGATIEGEMRELCAYGGLRGFALRRAPDEKFAR
            ||||||||||||||:|||||||||||||||||:|||||||||||||||||||||||||||
orf48-1     ELQNATFAKLLAQKDRFSVWESGSFPFIGATVEGEMRELCAYGGLRGFALRRAPDEKFAR
                 250       260       270       280       290       300

310       320       330       340       350       360
orf48a.pep  CLPNRLKQEGYATFAMHGAGSSLYDRFSWYPRAGFQEIKTAENLIGKKTCAIFGGVCDSE
            ||||||||||||||||||||||||||||||||||||||||||||||||||||||||||||
orf48-1     CLPNRLKQEGYATFAMHGAGSSLYDRFSWYPRAGFQEIKTAENLIGKKTCAIFGGVCDSE
                 310       320       330       340       350       360

370       380       390       400       410       420
orf48a.pep  LFGEVSAXFKKHDKGLFYWMTLTSHADYPESDIFNHRLKCTEYGLPAETDXCRNFSLHTQ
            ||||||| |||||||||||||||||||||||||||||||||||||||| |||||||||||
orf48-1     LFGEVSAFFKKHDKGLFYWMTLTSHADYPESDIFNHRLKCTEYGLPAETDLCRNFSLHTQ
                 370       380       390       400       410       420

430       440       450       460       470
orf48a.pep  FFDQLADLIQRPEMKGTEVIIVGDHPPPVGNLNETFRYLKQGHVXWLNFKIKX
            ||||||||||||||||||||||||||||||||||||||||||| ||||||||
orf48-1     FFDQLADLIQRPEMKGTEVIIVGDHPPPVGNLNETFRYLKQGHVAWLNFKIKX
                 430       440       450       460       470
```

Homology with a Predicted ORF from *N. gonorrhoeae*

ORF48 shows 97.5% identity over a 119aa overlap with a predicted ORF (ORF48ng) from *N. gonorrhoeae*:

```
orf48.pep   MNIHTLLSKQWTLPPFLPKRLLLSLLILLAPNAVFWVLALLTATARPIVNLDYLPAALLI   60
            ||||:|||:||||||||||||||||||||||||||||||||||||||||||||||||||
orf48ng     MNIHALLSEQWTLPPFLPKRLLLSLLILLAPNAVFWVLALLTATARPIVNLDYLPAALLI   60 orf48.pep   ALPWRFVKIAGVLAFWPAVLFDGLMMVIQLFPPFMDLIGAINLVPFILTAPAPYQIMTGL  119
            |||||||||||||||||||||||||||||||||||||||||||||||||||||||||||
orf48ng     ALPWRFVKIAGVLAFWPAVLFDGLMMVIQLFPPFMDLIGAINLVPFILTAPAPYQIMTGLL 120
```

The ORF48ng nucleotide sequence <SEQ ID 473> was predicted to encode a protein having amino acid sequence <SEQ ID 474>:

```
  1 MNIHALLSEQ WTLPPFLPKR LLLSLLILLA PNAVFWVLAL LTATARPIVN

51 LDYLPAALLI ALPWRFVKIA GVLAFWPAVL FDGLMMVIQL FPFMDLIGAI

101 NLVPFILTAP APYQIMTGLL LLYMLAMPFV LQKAAVKTDF RHIAVCAAVV

151 AAARYFTGPF ELLRTGGRWQ YVQHRRLLLS GSRASFRRRQ KADVLRRLGN

201 PYASMGNGG..
```

Further work identified the complete gonococcal DNA sequence <SEQ ID 475>:

```
   1 ATGAATATTC ACGCCCTGCT CTCCGAACAA TGGACGCTGC CGCCATTCCT
  51 GCCGAAACGG CTGCTGCTGT CCCTGCTGAT ACTGCTGGCC CCCAATGCGG
 101 TGTTTTGGGT TTTGGCACTG CTGACCGCCA CCGCCCGCCC GATTGTCAAT
 151 TTGGACTACC TTCCCGCCGC GCTGCTGATC GCCCTGCCTT GGCGTTTCGT
 201 CAAAATTGCC GGCGTATTGG CGTTTTGGCC GGCGGTTTTG TTTGACGGGC
 251 TGATGATGGT GATCCAACTC TTCCCTTTTA TGGACCTCAT CGGCGCCATC
 301 AACCTCGTCC CCTTCATCCT GACCGCCCCC GCCCCTTATC AGATAATGAC
 351 CGGGCTGTTG CTGCTGTATA TGCTGGCGAT GCCGTTTGTG TTGCAAAAAG
 401 CCGCCGTCAA AACCGACTTC CGACACATTG CCGTCTGTGC CGCCGTTGTG
 451 GCGGCAGCCG GCTATTTCAC CGGCCATTTG AGTTACTACG ACCGGGGCG
 501 GATGGCCAAT ATCTTCGGCG CAAACAACTT CTATTACGCc aAAAGTCAGG
 551 CGATGCTCTA CACCGTCAGC CAGAATGCCG ACTTTATTAC CGCCGgcctG
 601 GTCGACCCCG TCTTCCTCCC CTTGGGCAAT CAGCAGCGTG CCGCCACGCG
 651 GCTGAGTGAG CCGAAATCTC AAAAAATCCT CTTTATCGTC GCCGAATCTT
 701 GGGGGCTGCC GGGCAATCCC GAGCTTCAAA ACGCCACTTT TGCCAAACTG
 751 CTGGCGCAAA AAGACCGTTT TTCGGTTTGG GAAAGCGGCA GTTTTCCCTT
 801 CATCGGCGCG ACGGTCGAAG GCGAAATGCG CGAATTGTGC GCCTACGGCG
 851 GTTTGCGCGG GTTCGCACTG CGCCGCGCGC CCGACGAAAA ATTTGCCCGC
 901 TGCCTCCCCA ACCGTTTGAA ACAAGAAGGT TACGCCACCT TTGCGATGCA
 951 CGGCGCGGGT AGTTCGCTTT ACGACCGCTT CAGCTGGTAT CCGAGGGCGG
1001 GCTTTCAAAA AATCAAAACC GCCGAAAACC TGATCGGTAA AAAAACCTGC
1051 GCCATTTTCG GCGGCGTGTG CGACAGCGAG CTGTTCGGCG AAGTGTCGGC
1101 ATTTTTCAAA AAACACGACA AGGGACTGTT TTACTGGATG ACGCTGACCA
1151 GCCACGCCGA CTATCCCGAA TCCGACATTT TCAACCACAG GCTCAAATGC
1201 ACCGAATACG GCCTGCCCGC CGAAACCGAC CTCTGCCGCA ATTTCAGCCT
1251 GCACACCCAA TtcttcgACC AACTGGCGGA TTTGATCCGA CGCCCCGAAA
1301 TGAAAGGCAC GGAAGTCATC ATCGTCGGCG ACCATCCGCC GCCCGTCGGC
1351 AACCTCAATG AAACCTTCCG CTACCTCAAA CAGGGACACG TCGCCTGGCT
1401 GCACTTCAAA ATCAAATAA
```

This encodes a protein having amino acid sequence <SEQ ID 476; ORF48ng-1>:

```
  1 MNIHALLSEQ WTLPPFLPKR LLLSLLILLA PNAVFWVLAL LTATARPIVN
 51 LDYLPAALLI ALPWRFVKIA GVLAFWPAVL FDGLMMVIQL FPFMDLIGAI
101 NLVPFILTAP APYQIMTGLL LLYMLAMPFV LQKAAVKTDF RHIAVCAAVV
151 AAAGYFTGHL SYYDRGRMAN IFGANNFYYA KSQAMLYTVS QNADFITAGL
201 VDPVFLPLGN QQRAATRLSE PKSQKILFIV AESWGLPGNP ELQNATFAKL
251 LAQKDRFSVW ESGSFPFIGA TVEGEMRELC AYGGLRGFAL RRAPDEKFAR
```

```
301  CLPNRLKQEG YATFAMHGAG SSLYDRFSWY PRAGFQKIKT AENLIGKKTC

351  AIFGGVCDSE LFGEVSAFFK KHDKGLFYWM TLTSHADYPE SDIFNHRLKC

401  TEYGLPAETD LCRNFSLHTQ FFDQLADLIR RPEMKGTEVI IVGDHPPPVG

451  NLNETFRYLK QGHVAWLHFK IK*
```

ORG48ng-1 and ORF48-1 show 97.9% identity in 472 aa overlap:

```
                      10         20         30         40         50         60
    orf48-1.pep   MNIHTLLSKQWTLPPFLPKRLLLSLLILLAPNAVFWVLALLTATARPIVNLDYLPAALLI
                  ||||:|||:||||||||||||||||||||||||||||||||||||||||||||||||||
    orf48ng-1     MNIHALLSEQWTLPPFLPKRLLLSLLILLAPNAVFWVLALLTATARPIVNLDYLPAALLI
                      10         20         30         40         50         60

70         80         90        100        110        120
    orf48-1.pep   ALPWRFVKIAGVLAFWLAVLFDGLMMVIQLFPFMDLIGAINLVPFILTAPAPYQIMTGLL
                  |||||||||||||||| |||||||||||||||||||||||||||||||||||||||||||
    orf48ng-1     ALPWRFVKIAGVLAFWPAVLFDGLMMVIQLFPFMDLIGAINLVPFILTAPAPYQIMTGLL
                      70         80         90        100        110        120

130        140        150        160        170        180
    orf48-1.pep   LLYMLAMPFVLQKAAAKTDFRHIAVCAAVVAAAGYFTGHLSYYDRGRMANIFGANNFYYA
                  |||||||||||||||:||||||||||||||||||||||||||||||||||||||||||||
    orf48ng-1     LLYMLAMPFVLQKAAVKTDFRHIAVCAAVVAAAGYFTGHLSYYDRGRMANIFGANNFYYA
                     130        140        150        160        170        180

190        200        210        220        230        240
    orf48-1.pep   KSQAMLYTVSQNADFITAGLVDPVFLPLGNQQRAATHLNEPKSQKILFIVAESWGLPANP
                  |||||||||||||||||||||||||||||||||||:|:||||||||||||||||||:||
    orf48ng-1     KSQAMLYTVSQNADFITAGLVDPVFLPLGNQQRAATRLSEPKSQKILFIVAESWGLPGNP
                     190        200        210        220        230        240

250        260        270        280        290        300
    orf48-1.pep   ELQNATFAKLLAQKDRFSVWESGSFPFIGATVEGEMRELCAYGGLRGFALRRAPDEKFAR
                  ||||||||||||||||||||||||||||||||||||||||||||||||||||||||||||
    orf48ng-1     ELQNATFAKLLAQKDRFSVWESGSFPFIGATVEGEMRELCAYGGLRGFALRRAPDEKFAR
                     250        260        270        280        290        300

310        320        330        340        350        360
    orf48-1.pep   CLPNRLKQEGYATFAMHGAGSSLYDRFSWYPRAGFQEIKTAENLIGKKTCAIFGGVCDSE
                  |||||||||||||||||||||||||||||||||||:||||||||||||||||||||||||
    orf48ng-1     CLPNRLKQEGYATFAMHGAGSSLYDRFSWYPRAGFQKIKTAENLIGKKTCAIFGGVCDSE
                     310        320        330        340        350        360

370        380        390        400        410        420
    orf48-1.pep   LFGEVSAFFKKHDKGLFYWMTLTSHADYPESDIFNHRLKCTEYGLPAETDLCRNFSLHTQ
                  ||||||||||||||||||||||||||||||||||||||||||||||||||||||||||||
    orf48ng-1     LFGEVSAFFKKHDKGLFYWMTLTSHADYPESDIFNHRLKCTEYGLPAETDLCRNFSLHTQ
                     370        380        390        400        410        420

430        440        450        460        470
    orf48-1.pep   FFDQLADLIQRPEMKGTEVIIVGDHPPPVGNLNETFRYLKQGHVAWLHFKIKX
                  |||||||||:||||||||||||||||||||||||||||||||||||:|||||
    orf48ng-1     FFDQLADLIRRPEMKGTEVIIVGDHPPPVGNLNETFRYLKQGHVAWLHFKIKX
                     430        440        450        460        470
```

Based on this analysis, including the presence of a putative leader sequence (double-underlined) and two putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 57

The following partial DNA sequence was identified in *N. meningitidis* <SEQ ID 477>:

```
  1  ..GTGAGCGGAC GTTACCGCGC TTTGGATCGC GTTTCCAAAA TCATCATCGT

51    TACTTTGAGT ATCGCCACGC TTGCCGCCGC CGGCATCGCT ATGTCGCGCG

101    GTATGCAGAT GCAGTCCGAT TTTATCGAGC CGACACCGTG GACGCTTGCC

151    GGTTTGGGCT TCCTGATCGC GCTGATGGGC TGGATGCCCG CGCCGATTGA
```

```
-continued
201  AATTTCCGCC ATCAATTCTT TGTGGGTAAC CGAAAAACAA CGCATCAATC

251  CTTCCGAATA CCGCGACGGG ATTTTTGAAT TCAACGTCGG TTATATCGCC

301  AGTGCGGTTT TGGCTTTGGT TTTCCTTGCA CTGGGCGC.G TAGCGCCGAA

351  CGGCAACGGC GA.ACAGTGC AGATGGCGGG CGGCAAATAT AACGGGCAAT

401  TGATCAATAT GTACGCC..
```

This corresponds to the amino acid sequence <SEQ ID 478; ORF53>:

```
 1  ..VSGRYRALDR VSKIIIVTLS IATLAAAGIA MSRGMQMQSD FIEPTPWTLA

51    GLGFLIALMG WMPAPIEISA INSLWVTEKQ RINPSEYRDG IFEFNVGYIA

101   SAVLALVFLA LGXVAPNGNG XTVQMAGGKY NGQLINMYA..
```

Further work revealed the complete nucleotide sequence <SEQ ID 479>:

```
   1 ATGTCCGAAC AACATATTTC GACTTCGAAA ACTAAAATCA ACGCATTGGG

51 TCCGGCGATC ATGATGGCTT CGGCGGCGGT CGGCGGTTCG CACCTGATTG

101 CCTCGACGCA GGCGGGCGCG CTTTACGGCT GGCAGATCGC GCTCATCATC

151 ATCCTGACCA ACCTCTTCAA ATACCCGTTT TTCCGCTTCA GCGCGCATTA

201 CACGCTGGAC ACGGGCAAGA GCCTGATTGA AGGTTATGCC GAGAAAAGCC

251 GCGTTTATTT GTGGGTATTC CTGATTTTGT GCATCCTCTC CGCCACGATT

301 AACGCGGGCG CGGTCGCCAT TGTAACCGCC GCCATCGTCA AAATGGCGAT

351 TCCCTCGCTG ATGTTTGATG CCGGCACGGT TGCCGCCTTG ATTATGGCAT

401 CCTGCCTGAT TATTTTGGTG AGCGGACGTT ACCGCGCTTT GGATCGCGTT

451 TCCAAAATCA TCATCGTTAC TTTGAGTATC GCCACGCTTG CCGCCGCCGG

501 CATCGCTATG TCGCGCGGTA TGCAGATGCA GTCCGATTTT ATCGAGCCGA

551 CACCGTGGAC GCTTGCCGGT TTGGGCTTCC TGATCGCGCT GATGGGCTGG

601 ATGCCCGCGC CGATTGAAAT TTCCGCCATC AATTCTTTGT GGGTAACCGA

651 AAAACAACGC ATCAATCCTT CCGAATACCG GACGGGATT TTTGATTTCA

701 ACGTCGGTTA TATCGCCAGT GCGGTTTTGG CTTTGGTTTT CCTTGCACTG

751 GGCGCGTTTG TGCAATACGG CAACGGCGAA GCAGTGCAGA TGGCGGGCGG

801 CAAATATATC GGCCAATTGA TCAATATGTA CGCCGTTACC ATCGGCGGCT

851 GGTCGCGCCC GCTGGTGGCG TTTATCGCGT TTGCCTGTAT GTACGGCACG

901 ACGATTACCG TCGTGGACGG CTATGCCCGT GCCATTGCCG AACCCGTGCG

951 CCTGCTGCGC GGAAAAGACA AAACGGGCAA CGCCGAATTC TTTGCCTGGA

1001 ATATTTGGGT GGCGGGCAGC GGTTTGGCGG TGATTTTCTG GTTTGACGGC

1051 GTAATGGCGA ATCTGCTCAA ATTTGCGATG ATTGCCGCTT TGTGTCCGC

1101 CCCTGTGTTT GCCTGGCTGA ATTACCGTTT GGTTAAAGGT GATGAAAAAC
```

```
1151 ACAAACTCAC ATCAGGTATG AATGCCCTTG CATTGGCAGG CTTGATTTAT

1201 CTGACCGGTT TTACCGTTTT GTTCTTATTG AATTTGGCGG GAATGTTCAA

1251 ATGA
```

This corresponds to the amino acid sequence <SEQ ID 480; ORF53-1>:

```
  1 MSEQHISTWK SKINALGPGI MMASAAVGGS HLIASTQAGA LYGWQIALII

51 ILTNLFKYPF FRFSAHYTLD TGKSLIEGYA EKSRVYLWVF LILCILSATI

101 NAGAVAIVTA AIVKMAIPSL MFDAGTVAAL IMASCLIILV SGRYRALDRV

151 SKIIIVTLSI ATLAAAGIAM SRGMQMQSDF IEPTPWTLAG LGFLIALMGW

201 MPAPIEISAI NSLWVTEKQR INPSEYRDGI FDFNVGYIAS AVLALVFLAL

251 GAFVQYGNGE AVQMAGGKYI GQLINMYAVT IGGWSRPLVA FIAFACMYGT

301 TITVVDGYAR AIAEPVRLLR GKDKTGNAEF FAWNIWVAGS GLAVIFWFDG

351 VMANLLKFAM IAAFVSAPVF AWLNYRLVKG DEHKKLTSGM NALALAGLIY

401 LTGFTVLFLL NLAGMFK*
```

Computer analysis of this amino acid sequence gave the following results:

Homology with a Predicted ORF from *N. meningitidis* (Strain A)

ORF53 shows 93.5% identity over a 139aa overlap with an ORF (ORF53a) from strain A of *N. meningitidis*:

```
                                      10         20         30
orf53.pep                             VSGRYRALDRVSKIIIVTLSIATLAAAGIA
                                      ||||||||||||||||||||||||||||||
orf53a     AAIVKMIAPSLMFDAGTVAALIMASCLIILVSGRYRALDRVSKIIIVTLSIATLAAAGIA
           110       120       130       140       150       160
                  40         50         60         70         80         90
orf53.pep  MSRGMQMQSDFIEPTPWTLAGLGFLIALMGWMPAPIEISAINSLWVTEKQRINPSEYRDG
           ||||||||||||||||||||||||||||||||||||||||||||||||||||||||||||
orf53a     MSRGMQMQSDFIEPTPWTLAGLGFLIALMGWMPAPIEISAINSLWVTEKQRINPSEYRDG
           170       180       190       200       210       220
                 100        110        120        130      139
orf53.pep  IFEFNVGYIASAVLALVFLALGXVAPNGNGXTVQMAGGKYNGQLINMYA
           ||:|||||||||||||||||||: |||:||||||||||||| |||||||
orf53a     IFDFNVGYIASAVLALVFLALGAFVQYGNGEAVQMAGGKYIGQLINMYAVTIGGWSRPLV
           230       240       250       260       270       280 orf53a     AFIAFACMYGTTITVVDGYARAIAEPVRLLRGKDKTGNAEFFAWNIWVAGSGLAVIFWFD
           290       300       310       320       330       340
```

The complete length ORF53a nucleotide sequence <SEQ ID 481> is:

```
  1 ATGTCCGAAC AACATATTTC GACTTGGAAA AGTAAAATCA
    ACGCATTGGG

51 ACCGGGGATT ATGATGGCTT CGGCGGCGGT CGGCGGTTCG
    CACCTGATTG

101 CCTCGACGCA GGCGGGCGCG CTTTACGGCT GGCAGATCGC
    GCTCATCATC

151 ATCCTGACCA ACCTCTTCAA ATACCCGTTT TTCCGCTTCA
    GCGCGCATTA

201 CACGCTGGAC ACGGGCAAGA GCCTGATTGA AGGTTATGCC
    GAGAAAAGCC

251 GCGTTTATTT GTGGGTATTC CTGATTTTGT GCATCCTCTC
    CGCCACGATT

301 AACGCGGGCG CGGTCGCCAT TGTAACCGCC GCCATCGTCA
    AAATGGCGAT

351 TCCCTCGCTG ATGTTTGATG CCGGCACGGT TGCCGCCTTG
    ATTATGGCAT
```

-continued

```
 401 CCTGCCTGAT TATTTTGGTG AGCGGACGTT ACCGCGCTTT
     GGATCGCGTT

451 TCCAAAATCA TCATCGTTAC TTTGAGTATC GCCACGCTTG
     CCGCCGCCGG

501 CATCGCTATG TCGCGCGGTA TGCAGATGCA GTCCGATTTT
     ATCGAGCCGA

551 CACCGTGGAC GCTTGCCGGT TTGGGCTTCC TGATCGCGCT
     GATGGGCTGG

601 ATGCCCGCGC CGATTGAAAT TTCCGCCATC AATTCTTTGT
     GGGTAACCGA

651 AAAACAACGC ATCAATCCTT CCGAATACCG CGACGGGATT
     TTTGATTTCA

701 ACGTCGGTTA TATCGCCAGT GCGGTTTTGG CTTTGGTTTT
     CCTTGCACTG

751 GGCGCGTTTG TGCAATACGG CAACGGCGAA GCAGTGCAGA
     TGGCGGGCGG

801 CAAATATATC GGGCAATTGA TCAATATGTA CGCCGTTACC
     ATCGGCGGCT

851 GGTCGCGCCC GCTGGTGGCG TTTATCGCGT TTGCCTGTAT
     GTACGGCACG

901 ACGATTACCG TTGTGGACGG CTATGCCCGT GCCATTGCCG
     AACCCGTGCG

951 CCTGCTGCGC GGAAAAGACA AAACGGGCAA CGCCGAATTC
     TTTGCCTGGA

1001 ATATTTGGGT GGCGGGCAGC GGTTTGGCGG TGATTTTCTG
     GTTTGACGGC

1051 GTAATGGCGA ATCTGCTCAA ATTTGCGATG ATTGCCGCTT
     TTGTGTCCGC
```

```
1101 CCCTGTGTTT GCCTGGCTGA ATTACCGTTT GGTCAAAGGT
     GATGAAAAAC

1151 ACAAACTCAC ATCAGGTATG AATGCCCTTG CATTGGCAGG
     CTTGATTTAT

1201 CTGACCGGTT TTACCGTTTT GTTCTTATTG AATTTGGCGG
     GAATGTTCAA

1251 ATGA
```

This encodes a protein having amino acid sequence <SEQ ID 482>:

```
  1 MSEQHISTWK SKINALGPGI MMASAAVGGS HLIASTQAGA
    LYGWQIALII

51 ILTNLFKYPF FRFSAHYTLD TGKSLIEGYA EKSRVYLWVF
    LILCILSATI

101 NAGAVAIVTA AIVKMAIPSL MFDAGTVAAL IMASCLIILV
    SGRYRALDRV

151 SKIIIVTLSI ATLAAAGIAM SRGMQMQSDF IEPTPWTLAG
    LGFLIALMGW

201 MPAPIEISAI NSLWVTEKQR INPSEYRDGI FDFNVGYIAS
    AVLALVFLAL

251 GAFVQYGNGE AVQMAGGKYI GQLINMYAVT IGGWSRPLVA
    FIAFACMYGT

301 TITVVDGYAR AIAEPVRLLR GKDKTGNAEF FAWNIWVAGS
    GLAVIFWFDG

351 VMANLLKFAM IAAFVSAPVF AWLNYRLVKG DEKHKLTSGM
    NALALAGLIY

401 LTGFTVLFLL NLAGMFK*
```

ORF 53a shows 100.0% identity in 417 aa overlap with ORF53-1:

```
                        10         20         30         40         50         60
orf53a.pep    MSEQHISTWKSKINALGPGIMMASAAVGGSHLIASTQAGALYGWQIALIIILTNLFKYPF
              ||||||||||||||||||||||||||||||||||||||||||||||||||||||||||||
orf53-1       MSEQHISTWKSKINALGPGIMMASAAVGGSHLIASTQAGALYGWQIALIIILTNLFKYPF
                        10         20         30         40         50         60

70         80         90        100        110        120
orf53a.pep    FRFSAHYTLDTGKSLIEGYAEKSRVYLWVPLILCILSATINAGAVAIVTAAIVKMAIPSL
              ||||||||||||||||||||||||||||||||||||||||||||||||||||||||||||
orf53-1       FRFSAHYTLDTGKSLIEGYAEKSRVYLWVPLILCILSATINAGAVAIVTAAIVKMAIPSL
                        70         80         90        100        110        120

130        140        150        160        170        180
orf53a.pep    MFDAGTVAALIMASCLIILVSGRYRALDRVSKIIIVTLSIATLAAAGIAMSRGMQMQSDF
              ||||||||||||||||||||||||||||||||||||||||||||||||||||||||||||
orf53-1       MFDAGTVAALIMASCLIILVSGRYRALDRVSKIIIVTLSIATLAAAGIAMSRGMQMQSDF
                       130        140        150        160        170        180

190        200        210        220        230        240
orf53a.pep    IEPTPWTLAGLGFLIALMGWMPAPIEISAINSLWVTEKQRINPSEYRDGIFDFNVGYIAS
              ||||||||||||||||||||||||||||||||||||||||||||||||||||||||||||
orf53-1       IEPTPWTLAGLGFLIALMGWMPAPIEISAINSLWVTEKQRINPSEYRDGIFDFNVGYIAS
                       190        200        210        220        230        240

250        260        270        280        290        300
orf53a.pep    AVLALVFLALGAFVQYGNGEAVQMAGGKYIGQLINMYAVTIGGWSRPLVAFIAFACMYGT
              ||||||||||||||||||||||||||||||||||||||||||||||||||||||||||||
orf53-1       AVLALVFLALGAFVQYGNGEAVQMAGGKYIGQLINMYAVTIGGWSRPLVAFIAFACMYGT
                       250        260        270        280        290        300

310        320        330        340        350        360
orf53a.pep    TITVVDGYARAIAEPVRLLRGKDKTGNAEFFAWNIWVAGSGLAVIFWFDGVMANLLKFAM
              ||||||||||||||||||||||||||||||||||||||||||||||||||||||||||||
orf53-1       TITVVDGYARAIAEPVRLLRGKDKTGNAEFFAWNIWVAGSGLAVIFWFDGVMANLLKFAM
                       310        320        330        340        350        360
```

```
                      370        380        390        400        410
orf53a.pep    IAAFVSAPVFAWLNYRLVKGDEKHKLTSGMNALALAGLIYLTGFTVLFLLNLAGMFKX
              ||||||||||||||||||||||||||||||||||||||||||||||||||||||||||
orf53-1       IAAFVSAPVFAWLNYRLVKGDEKHKLTSGMNALALAGLIYLTGFTVLFLLNLAGMFKX
                      370        380        390        400        410
```

Homology with a Predicted ORF from *N. gonorrhoeae*

ORF53 shows 92.1% identity over a 139aa overlap with a predicted ORF (ORF53ng) from *N. gonorrhoeae*:

```
orf53.pep                                VSGRYRALDRVSKIIVTLSIATLAAAGIA   30
                                         ||||||||||||||||||||||||||||
orf53ng     AAIVKMAIPSLMFDAGTVAALIMASCLIILVSGRYRALDRVSKIIVTLSIATLAAAGIA   91
orf53.pep   MSRGMQMQSDFIEPTPWTLAGLGFLIALMGWMPAPIEISAINSLWVTEKQRINPSEYRDG  90
            ||||||||  ||||||||||||||||||||||||||||||||||||||||||||||||||
orf53ng     MSRGMQMQPDFIEPTPWTLAGLGFLIALMGWMPAPIEISAINSLWVTEKQRINPSEYRDG 151
orf53.pep   IFEFNVGYIASAVLALVFLALGXVAPNGNGXTVQMAGGKYNGQLINMYA            139
            ||:||||||||||||||||||| : |||:|||:|||| |||||||||||
orf53ng     IFDFNVGYIASAVLALVFLALGAFVQYGNGEAVQMGGGKYIGQLINMYAVTIGGGSRPLV 211
```

An ORF53ng nucleotide sequence <SEQ ID 483> was predicted to encode a protein having amino acid sequence <SEQ ID 484>:

```
  1 MPKKSCVYLW VFLILCIASA TINAGAVAIV TAAIVIMAIP
    SLMFDAGTVA

51 ALIMASCLII LVSGRYRALD RVSKIIIVTL SIATLAAAGI
    AMSRGMQMQP

101 DFIEPTPWTL AGLGFLIALM GWMPAPIEIS AINSLWVTEK
    QRINPSEYRD

151 GIFDFNVGYI ASAVLALVFL ALGAFVQYGN GEAVQMGGGK
    YIGQLINMYA

201 VTIGGGSRPL VAFIAFACMY GAASTVVDGY ARAIAEPVRL
    LRGKDKTARP

251 IVLLEKLGGR HRFGRDFLV*
```

Further analysis revealed further partial DNA gonococcal sequence <SEQ ID 485>:

```
  1 . . . aagaAAAGCT GCGTTTATTT GTGGGTTTTT
        TTGATTTTGT GTATCGCCTC

51 CGCCACGATT AACGCGGGCG CGGTCGCCAT TGTAACCGCC
    GCCATCGTCA

101 AAATGGCGAT TCCCTCGCTG ATGTTTGATG CCGGCACGGT
    TGCCGCCTTG

151 ATTATGGCAT CCTGCCTGAT TATTTTGGTG AGCGGACGTT
    ACCGCGCTTT

201 GGATCGTGTT TCCAAAATCA TCATTGTTAC TTTGAGCATC
    GCCACGCTTG

251 CCGCCGCCGG CATCGCTATG TCGCGCGGTA TGCAGATGCA
    GCCCGATTTT

301 ATCGAGCCGA CACCGTGGAC GCTTGCCGGT TTGGGCTTCC
    TGATCGCGCT

351 GATGGGCTGG ATGCCCGCGC CGATCGAAAT TTCCGCCATC
    AATTCTTTGT

401 GGGTAACCGA AAAACAACGC ATCAATCCTT CTGAATACCG
    CGACGGGATT

451 TTCGATTTCA ACGTCGGTTA TATCGCcagT GCGGTTTTGG
    CTTTGGTTTT

501 CCTTGCACTG GGCGCGTTTG TGCAATACGG CAACGGCGAA
    GCAGTGCAGA

551 TGGCGGGCGG CAAATATATC GGGCAATTGA TTAATATGTA
    TGCCGTAACC

601 ATCGGCGGCT GGTCTCGTCC GCTGGTGGCG TTTATCGCGT
    TTGCCTGTAT

651 GTACGGCACG ACGATTACCG TTGTGGACGG TTATGCGCGT
    GCCATTGCCG

701 AACCCGTGCG CCTGCTGCGC GGCAGGGATA AAACCGGCAA
    CGCCGAGTTG

751 TTtgccTGGA ATATTTGGGT GGCGGGCAGC GGTTTGGCGG
    TGATTTTCTG

801 GTTTGACggc gcaaTGGCgG AACtgcTCAA ATTTGCGATG
    ATtgccgcCT

851 TTGTGTCCGC CCCTGTGTTC GCCTGGCTCA ACTACCGCCT
    CGTCAAAGGG

901 GACAAACGCC ACAGGCTTAC CGCCGGTATG AACGCCCTTG
    CCATTGTCGG

951 CCTGCTCTAC CTGGCCGGGT TTGCCGTTTT GTTCCTGTTG
    AACCTTACCG

1001 GACTTTTGGC ATAG
```

This corresponds to the amino acid sequence <SEQ ID 486; ORF53ng-1>:

```
  1 . . . KKSCVYLWVF LILCIASATI NAGAVAIVTA
        AIVKMAIPSL MFDAGTVAAL

51 IMASCLIILV SGRYRALDRV SKIIIVTLSI ATLAAAGIAM
    SRGMQMQPDF

101 IEPTPWTLAG LGFLIALMGW MPAPIEISAI NSLWVTEKQR
    INPSEYRDGI
```

```
151 FDFNVGYIAS AVLALVFLAL GAFVQYGNGE AVQMAGGKYI
    GQLINMYAVT

201 IGGWSRPLVA FIAFACMYGT TITVVDGYAR AIAEPVRLLR
    GRDKTGNAEL

251 FAWNIWVAGS GLAVIFWFDG AMAELLKFAM IAAFVSAPVF
    AWLNYRLVKG

301 DKRHRLTAGM NALAIVGLLY LAGFAVLFLL NLTGLLA*
```

ORF53ng-1 and ORF53-1 show 94.0% identity in 336 aa overlap:

```
                   60         70         80         90        100        110
orf53-1.pep    ILTNLFKYPFFRFSAHYTLDTGKSLIEGYAEKSRVYLWVFLILCILSATINAGAVAIVTA
                                       :||  ||||||||||||  ||||||||||||||
orf53ng-1                              KKSCVYLWVFLILCIASATINAGAVAIVTA
                                                10         20         30
                  120        130        140        150        160        170
orf53-1.pep    AIVKMAIPSLMFDAGTVAALIMASCLIILVSGRYRALDRVSKIIIVTLSIATLAAAGIAM
               ||||||||||||||||||||||||||||||||||||||||||||||||||||||||||||
orf53ng-1      AIVKMAIPSLMFDAGTVAALIMASCLIILVSGRYRALDRVSKIIIVTLSIATLAAAGIAM
                        40         50         60         70         80         90
                  180        190        200        210        220        230
orf53-1.pep    SRGMQMQSDFIEPTPWTLAGLGFLIALMGWMPAPIEISAINSLWVTEKQRINPSEYRDGI
               ||||||:||||||||||||||||||||||||||||||||||||||||||||||||||||
orf53ng-1      SRGMQMQPDFIEPTPWTLAGLGFLIALMGWMPAPIEISAINSLWVTEKQRINPSEYRDGI
                       100        110        120        130        140        150
                  240        250        260        270        280        290
orf53-1.pep    FDFNVGYIASAVLALVFLALGAFVQYGNGEAVQMAGGKYIGQLINMYAVTIGGWSRPLVA
               ||||||||||||||||||||||||||||||||||||||||||||||||||||||||||||
orf53ng-1      FDFNVGYIASAVLALVFLALGAFVQYGNGEAVQMAGGKYIGQLINMYAVTIGGWSRPLVA
                       160        170        180        190        200        210
                  300        310        320        330        340        350
orf53-1.pep    FIAFACMYGTTITVVDGYARAIAEPVRLLRGKDTGNAEFFAWNIWVAGSGLAVIFWFDG
               ||||||||||||||||||||||||||||||||:|||||||:|||||||||||||||||||
orf53-1        FIAFACMYGTTITVVDGYARAIAEPVRLLRGRDKTGNAELFAWNIWVAGSGLAVIFWFDG
                       220        230        240        250        260        270
                  360        370        380        390        400        410
orf53-1.pep    VMANLLKFAMIAAFVSAPVFAWLNYRLVKGDEKHKLTSGMNALALAGLIYLTGFTVLFLL
               :||:|||||||||||||||||||||||||||:|::|:||||||:::||:|:|:|||||
orf53ng-1      AMAELLKFAMIAAFVSAPVFAWLNYRLVKGDKRHRLTAGMNALAIVGLLYLAGFAVLFLL
                       280        290        300        310        320        330
orf53-1.pep    NLAGMFKX
               ||:|::
orf53ng-1      NLTGLLAX
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 58

The following partial DNA sequence was identified in *N. meningitidis* <SEQ ID 487>:

```
  1 . . . TTGCGGGAAA CGGCATATGT TTTGGATAGT
        TTTGATCGTT ATTTTGTTGT

51 TGCGCTTGCC GGCTTGTTTT TTGTCCGCGC ACAATCCGAA
        CGCGAGTGGA

101 TGCGCGAGGT TTCTGCGTGG CAGGAAAAGA AAGGGGAAAA
        ACAGGCGGAG

151 CTGCCTGAAA TCAAAGACGG TATGCCCGAT TTTCCCGAAC
        TTGCCCTGAT
```

```
201 GCTTTTCCAC GCCGTCAAAA CGGCAGTGTA TTGGCTGTTT
        GTCGGTGTCG

251 TCCGTTTCTG CCGAAACTAT CTGGCGCACG AATCCGAACC
        GGACAGGCCC

301 GTTCCGCCT . . .
```

This corresponds to the amino acid sequence <SEQ ID 488; ORF58>:

```
  1 . . . LRETAYVLDS FDRYFVVALA GLFFVRAQSE
        REWMREVSAW QEKKGEKQAE

51 LPEIKDGMPD FPELALMLFH AVKTAVYWLF VGVVRFCRNY
        LAHESEPDRP

101 VPP . . .
```

Further work revealed the complete nucleotide sequence <SEQ ID 489>:

```
  1 ATGTTTTGGA TAGTTTTGAT CGTTATTTTG TTGCTTGCGC
        TTGCCGGCTT

51 GTTTTTTGTC CGCGCACAAT CCGAACGCGA GTGGATGCGC
        GAGGTTTCTG

101 CGTGGCAGGA AAAGAAAGGG GAAAAACAGG CGGAGCTGCC
        TGAAATCAAA

151 GACGGTATGC CCGATTTTCC CGAACTTGCC CTGATGCTTT
        TCCATGCCGT
```

-continued

```
 201  CAAAACGGCA GTGTATTGGC TGTTTGTCGG TGTCGTCCGT
      TTCTGCCGAA
 251  ACTATCTGGC GCACGAATCC GAACCGGACA GGCCCGTTCC
      GCCTGCTTCT
 301  GCAAACCGTG CGGATGTTCC GACCGCATCC GACGGATATT
      CAGACAGTGG
 351  AAACGGGACG AAGAAGCGG AAACGGAAGA AGCAGAAGCT
      GCGGAGGAAG
 401  AGGCTGCCGA TACGGAAGAC ATTGCAACTG CCGTAATCGA
      CAACCGCCGC
 451  ATCCCATTCG ACCGGAGTAT TGCTGAAGGG TTGATGCCGT
      CTGAAAGCGA
 501  AATTTCGCCC GTCCGTCCGG TTTTTAAAGA AATCACTTTG
      GAAGAAGCAA
 551  CGCGTGCTTT AAACAGCGCG GCTTTAAGGG AAACGAAAAA
      ACGCTATATC
 601  GATGCATTTG AGAAAAACGA AACAGCGGTC CCCAAAGTCC
      GCGTGTCCGA
 651  TACCCCGATG GAAGGGCTGC AGATTATCGG TTTGGACGAC
      CCTGTGCTTC
 701  AACGCACGTA TTCCCATATG TTCGATGCGG ACAAAGAAGC
      GTTTTCCGAG
 751  TCTGCGGATT ACGGATTTGA GCCGTATTTT GAGAAGCAGC
      ATCCGTCTGC
 801  CTTTTCTGCA GTCAAAGCCG AAAATGCACG GAATGCGCCG
      TTCCACCGTC
 851  ATGCAGGGCA GGGGAAAGGG CAGGCGGAGG CAAAATCCCC
      GGATGTTCC
 901  CAAGGGCAGT CCGTTTCAGA CGGCACGGCC GTCCGCGATG
      CCCGCCGCCG
 951  CGTTTCCGTC AATTTGAAAG AACCGAACAA GGCAACGGTT
      TCTGCGGAGG
1001  CGCGAATTTC TCGCCTGATT CCGAAAGTC AGACGGTTGT
      CGGGAAACGG
1051  GATGTCGAAA TGCCGTCTGA AACCGAAAAT GTTTTCACGG
      AAACCGTTTC
1101  GTCTGTGGGA TACGGCGGTC CGGTTTATGA TGAAACTGCC
      GATATCCATA
1151  TTGAAGAACC TGCCGCGCCC GATGCTTGGG TGGTCGAACC
      ACCCGAAGTG
1201  CCGAAAGTTC CCATGACCGC AATCGATATT CAGCCGCCGC
      CTCCCGTATC
1251  GGAAATCTAC AACCGTACCT ATGAACCGCC GTCAGGATTC
      GAGCAGGTGC
1301  AACGCAGCCG CATTGCCGAG ACCGACCATC TTGCCGATGA
      TGTTTTGAAT
1351  GGAGGTTGGC AGGAGGAAAC CGCCGCTATT GCGGATGACG
      GCAGTGAAGG
1401  TGCGGCAGAG CGGTCAAGCG GCAATATCT GTCGGAAACC
      GAAGCGTTCG
1451  GGCATGACAG TCAGGCGGTT TGTCCGTTTG AAAATGTGCC
      GTCTGAACGC
1501  CCGTCCTGCC GGGTATCGGA TACGGAAGCG GATGAAGGGG
      CCTTCCCATC
1551  TGAAGAAACC GGTGCGGTAT CCGAACACCT GCCGACAACC
      GACCTGCTTC
1601  TGCCTCCGCT GTTCAATCCC GAGGCGACGC AAACCGAAGA
      AGAACTGTTG
1651  GAAAACAGCA TCACCATCGA AGAAAAATTG GCGGAGTTCA
      AAGTCAAGGT
1701  CAAGGTTGTC GATTCTTATT CCGGCCCCGT AATTACGCGT
      TATGAAATCG
1751  AACCCGATGT CGGCGTGCGC GGCAATTCCG TTCTGAATCT
      GGAAAAAGAT
1801  TTGGCGCGTT CGCTCGGCGT GGCTTCCATC CGCGTTGTCG
      AAACCATCCC
1851  CGGCAAAACC TGCATGGGTT TGGAACTTCC GAACCCGAAA
      CGCCAAATGA
1901  TACGCCTGAG CGAAATCTTC AATTCGCCCG AGTTTGCCGA
      ATCCAAATCC
1951  AAGCTGACGC TCGCGCTCGG TCAGGACATC ACCGGACAGC
      CGTCGTAAC
2001  CGACTTGGGA AAAGCACCGC ATTTGTTGGT TGCCGGCACG
      ACCGGTTCGG
2051  GCAAATCGGT GGGTGTCAAC GCGATGATTC TGTCTATGCT
      TTTCAAAGCC
2101  GCGCCGGAAG ACGTGCGTAT GATTATGATC GATCCGAAAA
      TGCTGGAATT
2151  GAGCATTTAC GAAGGCATCC CGCACCTGCT CGCCCCTGTC
      GTTACCGATA
2201  TGAAGCTGGC GGCAAACGCG CTGAACTGGT GTGTTAACGA
      AATGGAAAAA
2251  CGCTACCGCC TGATGAGCTT TATGGGCGTG CGTAATCTTG
      CGGGCTTCAA
2301  TCAAAAAATC GCCGAAGCCG CAGCAAGGGG AGAAAAAATC
      GGCAATCCGT
2351  TCAGCCTCAC GCCCGACGAT CCCGAACCTT GGAAAAACT
      GCCGTTTATC
2401  GTGGTCGTGG TCGATGAGTT TGCCGACCTG ATGATGACGG
      CAGGCAAGAA
2451  AATCGAAGAA CTGATTGCCC GCCTCGCCCA AAAAGCCCGC
      GCGGCAGGCA
2501  TCCATTTGAT TCTTGCCACA CAACGCCCCA GCGTCGATGT
      CATCACGGGT
2551  CTGATTAAGG CGAACATCCC CACGCGTATC GCGTTCCAAG
      TGTCCAGCAA
2601  AATCGACAGC CGCACGATTC TCGACCAAAT GGGCGCGGAA
      AACCTGCTCG
2651  GTCAGGGCGA TATGCTGTTC CTGCTGCCGG TACTGCCTA
      TCCGCAGCGC
2701  GTTCACGGCG CGTTTGCCTC GGATGAAGAG CTGCACCGCG
      TGGTCGAATA
2751  TTTGAAACAG TTTGGCGAAC CGGACTATGT TGACGATATT
      TTGAGCGGCG
```

```
2801 GCGGCAGCGA AGAGCTGCCC GGCATCGGGC GCAGCGGCGA
     CGACGAAACC

2851 GATCCGATGT ACGACGAGGC CGTATCCGTT GTCCTGAAAA
     CGCGCAAAGC

2901 CAGCATTTCG GGCGTACAGC GCGCCTTGCG TATCGGCTAC
     AACCGCGCCG

2951 CGCGTCTGAT TGACCAGATG GAGGCGGAAG GCATTGTGTC
     CGCACCGGAA

3001 CACAACGGCA ACCGTACGAT TCTCGTCCCC TTGGACAATG
     CTTGA
```

This corresponds to the amino acid sequence <SEQ ID 490; ORF58-1>:

```
  1 MFWIVLIVIL LLALAGLFFV RAQSEREWMR EVSAWQEKKG
    EKQAELPEIK

51 DGMPDFPELA LMLFHAVKTA VYWLFVGVVR FCRNYLAHES
    EPDRPVPPAS

101 ANRADVPTAS DGYSDSGNGT EEAETEEAEA AEEEAADTED
    IATAVIDNRR

151 IPFDRSIAEG LMPSESEISP VRPVFKEITL EEATRALNSA
    ALRETKKRYI

201 DAFEKNETAV PKVRVSDTPM EGLQIIGLDD PVLQRTYSHM
    FDADKEAFSE

251 SADYGFEPYF EKQHPSAFSA VKAENARNAP FHRHAGQGKG
    QAEAKSPDVS
```

```
-continued
301 QGQSVSDGTA VRDARRRVSV NLKEPNKATV SAEARISRLI
    PESQTVVGKR

351 DVEMPSETEN VFTETVSSVG YGGPVYDETA DIHIEEPAAP
    DAWVVEPPEV

401 PKVPMTAIDI QPPPPVSEIY NRTYEPPSGF EQVQRSRIAE
    TDHLADDVLN

451 GGWQEETAAI ADDGSEGAAE RSSGQYLSET EAFGHDSQAV
    CPFENVPSER

501 PSCRVSDTEA DEGAFPSEET GAVSEHLPTT DLLLPPLFNP
    EATQTEEELL

551 ENSITIEEKL AEFKVKVKVV DSYSGPVITR YEIEPDVGVR
    GNSVLNLEKD

601 LARSLGVASI RVVETIPGKT CMGLELPNPK RQMIRLSEIF
    NSPEFAESKS

651 KLTLALGQDI TGQPVVTDLG KAPHLLVAGT TGSGKSVGVN
    AMILSMLFKA

701 APEDVRMIMI DPKMLELSIY EGIPHLLAPV VTDMKLAANA
    LNWCVNEMEK

751 RYRLMSFMGV RNLAGFNQKI AEAAARGEKI GNPFSLTPDD
    PEPLEKLPFI

801 VVVVDEFADL MMTAGKKIEE LIARLAQKAR AAGIHLILAT
    QRFSVDVITG

851 LIKANIPTRI AFQVSSKIDS RTILDQMGAE NLLGQGDMLF
    LLPGTAYPQR

901 VHGAFASDEE VHRVVEYLKQ FGEPDYVDDI LSGGGSEELP
    GIGRSGDDET

951 DPMYDEAVSV VLKTRKASIS GVQRALRIGY NRAARLIDQM
    EAEGIVSAPE

1001 HNGNRTILVP LDNA*
```

Computer analysis of this amino acid sequence predicts the indicated transmembrane region, and also gave the following results:

Homology with a Predicted ORF from *N. meningitidis* (Strain A)

ORF58 shows 96.6% identity over a 89aa overlap with an ORF (ORF58a) from strain A of *N. meningitidis*:

```
                     10         20         30         40         50         60
orf58.pep  LRETAYVLDSFDRYFVVALAGLFFVRAQSEREWMREVSAWQEKKGEKQAELPEIKDGMPD
           :::|||||||||||||||||||||||||||||||||||||||||||
orf58a           MFWIVLIVILLLALAGLFFVRAQSEREWMREVSAWQEKKGEKQAELPEIKDGMPD
                       10         20         30         40         50

70         80         90        100
orf58.pep  FPELALMLFHAVKTAVYWLFVGVVRFCRNYLAHESEPDRPVPP
           ||||||||||||||||||||||||||||||||||||||||||
orf58a     FPELALMLFHAVKTAVYWLFVGVVRFCRNYLAHESEPDRPVPPASANRADVPTASDGYSD
                60         70         80         90        100        110
```

The complete length ORF58a nucleotide sequence <SEQ ID 491> is:

```
  1 ATGTTTTGGA TAGTTTTGAT CGTTATTTTG TTGCTTGCGC
    TTGCCGGCTT

51 GTTTTTTGTC CGCGCACAAT CCGAACGCGA GTGGATGCGC
    GAGGTTTCTG

101 CGTGGCAGGA AAAGAAAGGG GAAAAACAGG CGGAGCTGCC
    TGAAATCAAA

151 GACGGTATGC CCGATTTTCC CGAACTTGCC CTGATGCTTT
    TCCATGCCGT

201 CAAAACGGCA GTGTATTGGC TGTTTGTCGG TGTCGTCCGT
    TTCTGCCGAA

251 ACTATCTGGC GCACGAATCC GAACCGGACA GGCCCGTTCC
    GCCTGCTTCT
```

-continued

```
 301 GCAAATCGTG CGGATGTTCC GACCGCATCC GACGGATATT
     CAGACAGTGG

351 AAACGGGACG GAAGAAGCGG AAACGGAAGA AGCAGAAGCT
     GCGGAGGAAG

401 AGGCTGCCGA TACGGAAGAC ATTGCAACTG CCGTAATCGA
     CAACCGCCGC

451 ATCCCATTCG ACCGGAGTAT TGCTGAAGGG TTGATGCCGT
     CTGAAAGCGA

501 AATTTCGCCC GTCCGTCCGG TTTTTAAGGA AATCACTTTG
     GAAGAAGCAA

551 CGCGTGCTTT AAACAGCGCG GCTTTAAGGG AAACGAAAAA
     ACGCTATATC

601 GATGCATTTG AGAAAAACGA AACAGCGGTC CCCAAAGTCC
     GCGTGTCCGA

651 TACCCCGATG GAAGGGCTGC AGATTATCGG TTTGGACGAC
     CCTGTGCTTC

701 AACGCACGTA TTCCCGTATG TTCGATGCGG ACAAAGAAGC
     GTTTTCCGAG

751 TCTGCGGATT ACGGATTTGA GCCGTATTTT GAGAAGCAGC
     ATCCGTCTGC

801 CTTTTCTGCA GTCAAAGCCG AAAATGCACG GAATGCGCCG
     TTCCGCCGTC

851 ATGCAGGGCA GGGNAAAGGG CAGGCGGAGG CNAAATCCCC
     GGATGTTTCC

901 CAAGGGCAGT CCGTTTCAGA CGGCACAGCC GTCCGCGATG
     CCNGCCGCCG

951 CGTTTCCGTC AATTTGAAAG AACCGAACAA GGCAACGGTT
     TCTGCGGAGG

1001 CGCGGATTTC GCGCCTGATT CCGGAAAGTC GGACGGTTGT
     CGGGAAACGG

1051 GATGTCGAAA TGCCGTCTGA AACCGAAAAT GTTTTCACGG
     AAANTGTTTC

1101 GTCTGTGGGA TACGGCGNTC CGGTTTATGA TGAAACTGCC
     GATATCCATA

1151 TTGAAGAACC TGCCGCGCCC GATGCTTGGG TGGTCGAACC
     ACCCGAAGTG

1201 CCGAAAGTTC CCATGCCCGC AATNGATATT CCGCCGCCGC
     CTCCCGTATC

1251 GGAAATCTAC AACCGTACCT ATGAACCGCC GGCAGGATTC
     GAGCAGGTGC

1301 AACGCAGCCG CATTGCCGAA ACCGATCATC TTGCCGATGA
     TGTTTTGAAT

1351 GGAGGTTGGC AGGAGGAAAC CGCCGCTATT GCGAATGACG
     GCAGTGAGGG

1401 TGTGGCAGAG CGGTCAAGCG GGCAATATTT GTCGGAAACC
     GAAGCGTTCG

1451 GGCATGACAG TCAGGCGGTT TGTCCGTTTG AAAATGTGCC
     GTCTGAACGC

1501 CCGTCCCGCC GGGCATNGGA TACGGAAGCG GATGAAGGGG
     CGTTCCAATC

1551 TGAAGAAACC GGTGCGGTAT CCGAACACCT GCCGACAACC
     GACCTGCTTC

1601 TGCCGCCGCT GTTCAATCCC GGGGCGACGC AAACCGAAGA
     AGANCTGTTG

1651 GANAACAGCA TCACCATCGA AGAAAAATNG GCGGAGTTCA
     AAGTCAAGGT

1701 CAAGGTTGTC GATTCTTATT CCGGCCCCGT GATTACGCGT
     TATGAAATCG

1751 AACCCGATGT CGGCGTGCGC GGCAATTCCG TTCTAAATCT
     GGAAAAAGAN

1801 TTGGCGCGTT CGCTCGGCGT GGCTTCCATC CGCGTTGTCG
     AAACCATCCT

1851 CGGCAAAACC TGTATGGGTT TGGAACTTCC GAACCCGAAA
     CGCCAAATGA

1901 TACGCCTGAG CGAAATCTTC AATTCGCCCG AGTTTGCCGA
     ATCCAAATCC

1951 AAGCTGACGC TCGCGCTCGG TCAGGACATC ACCGGACAGC
     CCGTCGTAAC

2001 CGACTTGGGC AAAGCACCGC ATTTGTTGGT TGCCGGCACG
     ACCGGTTCGG

2051 GCAAATCGGT GGGTGTCAAC GCGATGATTC TGTCTATGCT
     TTTCAAAGCC

2101 GCGCCGGAAG ACGTGCGTAT GATTATGATC GATCCGAAAA
     TGCTGGAATT

2151 GAGCATTTAC GAAGGCATCC CGCACCTGCT CGCCCCTGTC
     GTTACCGATA

2201 TGAAGCTGGC GGCAAACGCG CTGAACTGGT GTGTTAACGA
     AATGGAAAAA

2251 CGCTACCGCC TGATGAGCTT TATGGGCGTG CGCAATCTTG
     CGGGTNTCAA

2301 TCAAAAAATC GCCGAAGCCG CAGCAAGGGG GGAGAAAATC
     GGCAACCCGT

2351 TCAGCCTCAC GCCCGACAAT CCCGAACCTT TGGANAAATT
     GCCGTTTATC

2401 GTGGTCGTGG TTGATGAGTT TGCCGACCTG ATGATGACGG
     CAGGCAAGAA

2451 AATCGAAGAA CTGATTGCCC GCCTCGCCCA AAAAGCCCGC
     GCGGCAGGCA

2501 TCCATCTTAT CCTTGCCACA CAACGCCCCA GTGTCGATGT
     CATCACGGGT

2551 CTGATTAAGG CGAACATCCC GACGCGTATC GCGTTCCAAG
     TGTCCAGCAA

2601 AATCGACAGC CGCACGATTC TTGACCAAAT GGGTGCGGAA
     AACCTGCTCG

2651 GGCAGGGCGA TATGCTGTTC CTGCCGCCGG GTACGGCCTA
     TCCGCAGCGC

2701 GTTCACGGCG CGTTTGCCTC GGATGAAGAG GTGCACCGCG
     TGGTCGAATA

2751 TCTGAAACAG TTTGGCGAAC CGGACTATGT TGACGATATN
     TTGAGCGGCG

2801 GTATGTCCGA CGATTTGCTG GGAATCAGCC GGAGCGGCGA
     CGGCGAAACC

2851 GATCCGATGT ACGACGAGGC CGTGTCNGTT GTTTTGAAAA
     CGCGCAAAGC
```

-continued

```
2901 CAGCATTTCT GGCGTGCAGC GCGCATTGCG TATCGGCTAT
     AATCGCGCCG

2951 CGCGTCTGAT TGACCAGATG GAGGCGGAAG GCATTGTGTC
     CGCACCGGAA

3001 CACAACGGCA ACCGTACGAT TCTCGTCCCC TTNGACAATG
     CTTGA
```

This encodes a protein having amino acid sequence <SEQ ID 492>:

```
  1 MFWIVLIVIL LLALAGLFFV RAQSEREWMR EVSAWQEKKG
    EKQAELPEIK

51 DGMPDFPELA LMLFHAVKTA VYWLFVGVVR FCRNYLAHES
    EPDRPVPPAS

101 ANRADVPTAS DGYSDSGNGT EEAETEEAEA AEEEAADTED
    IATAVIDNRR

151 IPFDRSIAEG LMPSESEISP VRPVFKEITL EEATRALNSA
    ALRETKKRYI

201 DAFEKNETAV PKVRVSDTPM EGLQIIGLDD PVLQRTYSRM
    FDADKEAFSE

251 SADYGFEPYF EKQHPSAFSA VKAENARNAP FRRHAGQGKG
    QAEAKSPDVS

301 QGQSVSDGTA VRDAXRRVSV NLKEPNKATV SAEARISRLI
    PESRTVVGKR

351 DVEMPSETEN VFTEXVSSVG YGXPVYDETA DIHIEEPAAP
    wDAWVVEPPEV

401 PKVPMPAXDI PPPPPVSEIY NRTYEPPAGF EQVQRSRIAE
    TDHLADDVLN

451 GGWQEETAAI ANDGSEGVAE RSSGQYLSET EAFGHDSQAV
    CPFENVPSER

501 PSRRAXDTEA DEGAFQSEET GAVSEHLPTT DLLLPPLFNP
    GATQTEEXLL

551 XNSITIEEKX AEEKVKVKVV DSYSGPVITR YEIEPDVGVR
    GNSVLNLEKX

601 LARSLGVASI RVVETILGKT CMGLELPNPK RQMIRLSEIF
    NSPEFAESKS

651 KLTLALGQDI TGQPVVTDLG KAPHLLVAGT TGSGKSVGVN
    AMILSMLFKA

701 APEDVRMIMI DPKMLELSIY EGIPHLLAPV VTDMKLAANA
    LNWCVNEMEK

751 RYRLMSFMGV RNLAGXNQKI AEAAARGEKI GNPFSLTPDN
    PEPLXKLPFI

801 VVVVDEFADL MMTAGKKIEE LIARLAQKAR AAGIHLILAT
    QRPSVDVITG

851 LIKANIPTRI AFQVSSKIDS RTILDQMGAE NLLGQGDMLF
    LPPGTAYPQR

901 VHGAFASDEE VHRVVEYLKQ FGEPDYVDDX LSGGMSDDLL
    GISRSGDGET

951 DPMYDEAVSV VLKTRKASIS GVQRALRIGY NRAARLIDQM
    EAEGIVSAPE

1001 HNGNRTILVP XDNA*
```

ORF58a and ORF58-1 show 96.6% identity in 1014 aa overlap:

```
                    10         20         30         40         50         60
orf58a.pep  MFWIVLIVILLLALAGLFFVRAQSEREWMREVSAWQEKKGEKQAELPEIKDGMPDFPELA
            ||||||||||||||||||||||||||||||||||||||||||||||||||||||||||||
orf58-1     MFWIVLIVILLLALAGLFFVRAQSEREWMREVSAWQEKKGEKQAELPEIKDGMPDFPELA
                    10         20         30         40         50         60

70         80         90        100        110        120
orf58a.pep  LMLFHAVKTAVYWLFVGVVRFCRNYLAHESEPDRPVPPASANRADVPTASDGYSDSGNGT
            ||||||||||||||||||||||||||||||||||||||||||||||||||||||||||||
orf58-1     LMLFHAVKTAVYWLFVGVVRFCRNYLAHESEPDRPVPPASANRADVPTASDGYSDSGNGT
                    70         80         90        100        110        120

130        140        150        160        170        180
orf58a.pep  EEAETEEAEAAEEEAADTEDIATAVIDNRRIPFDRSIAEGLMPSESEISPVRPVFKEITL
            ||||||||||||||||||||||||||||||||||||||||||||||||||||||||||||
orf58-1     EEAETEEAEAAEEEAADTEDIATAVIDNRRIPFDRSIAEGLMPSESEISPVRPVFKEITL
                   130        140        150        160        170        180

190        200        210        220        230        240
orf58a.pep  EEATRALNSAALRETKKRYIDAFEKNETAVPKVRVSDTPMEGLQIIGLDDPVLQRTYSRM
            |||||||||||||||||||||||||||||||||||||||||||||||||||||||||:|
orf58-1     EEATRALNSAALRETKKRYIDAFEKNETAVPKVRVSDTPMEGLQIIGLDDPVLQRTYSHM
                   190        200        210        220        230        240

250        260        270        280        290        300
orf58a.pep  FDADKEAFSESADYGFEPYFEKQHPSAFSAVKAENARNAPFRRHAGQGKGQAEAKSPDVS
            ||||||||||||||||||||||||||||||||||||||||||:|||||||||||||||||
orf58-1     FDADKEAFSESADYGFEPYFEKQHPSAFSAVKAENARNAPFRHHAGQGKGQAEAKSPDVS
                   250        260        270        280        290        300

310        320        330        340        350        360
orf58a.pep  QGQSVSDGTAVRDAXRRVSVNLKEPNKATVSAEARISRLIPESRTVVGKRDVEMPSETEN
            ||||||||||||||:|||||||||||||||||||||||||||:|||||||||||||||||
orf58-1     QGQSVSDGTAVRDARRRVSVNLKEPNKATVSAEARISRLIPESQTVVGKRDVEMPSETEN
                   310        320        330        340        350        360

370        380        390        400        410        420
orf58a.pep  VFTEXVSSVGYGXPVYDETADIHIEEPAAPDAWVVEPPEVPKVPMPAXDIPPPPPVSEIY
            ||||:|||||||||||||||||||||||||||||||||||||||||:|||||||||||||
orf58-1     VFTETVSSVGYGGPVYDETADIHIEEPAAPDAWVVEPPEVPKVPMTAIDIQPPPPVSEIY
                   370        380        390        400        410        420
```

```
              430        440        450        460        470        480
orf58a.pep  NRTYEPPAGFEQVQRSRIAETDHLADDVLNGGWQEETAAIANDGSEGVAERSSGQYLSET
            ||||||:||||||||||||||||||||||||||||||:||||:||||||||||||||||
orf58-1     NRTYEPPSGFEQVQRSRIAETDHLADDVLNGGWQEETAAIADDGSEGAAERSSGQYLSET
              430        440        450        460        470        480

490        500        510        520        530        540
orf58a.pep  EAFGHDSQAVCPFENVPSERPSRRAXDTEADEGAFQSEETGAVSEHLPTTDLLLPPLFNP
            ||||||||||||||||||||||||| :|||||||||| ||||||||||||||||||||||
orf58-1     EAFGHDSQAVCPFENVPSERPSCRVSDTEADEGAFPSEETGAVSEHLPTTDLLLPPLFNP
              490        500        510        520        530        540

550        560        570        580        590        600
orf58a.pep  GATQTEEXLLXNSITIEEKXAEFKVKVKVVDSYSGPVITRYEIEPDVGVRGNSVLNLEKX
            ||||||  || |||||||| |||||||||||||||||||||||||||||||||||||||
orf58-1     EATQTEEELLENSITIEEKLAEFKVKVKVVDSYSGPVITRYEIEPDVGVRGNSVLNLEKD
              550        560        570        580        590        600

610        620        630        640        650        660
orf58a.pep  LARSLGVASIRVVETILGKTCMGLELPNPKRQMIRLSEIFNSPEFAESKSKLTLALGQDI
            |||||||||||||||||:|||||||||||||||||||||||||||||||||||||||||
orf58-1     LARSLGVASIRVVETIPGKTCMGLELPNPKRQMIRLSEIFNSPEFAESKSKLTLALGQDI
              610        620        630        640        650        660

670        680        690        700        710        720
orf58a.pep  TGQPVVTDLGKAPHLLVAGTTGSGKSVGVNAMILSMLFKAAPEDVRMIMIDPKMLELSIY
            ||||||||||||||||||||||||||||||||||||||||||||||||||||||||||||
orf58-1     TGQPVVTDLGKAPHLLVAGTTGSGKSVGVNAMILSMLFKAAPEDVRMIMIDPKMLELSIY
              670        680        690        700        710        720

730        740        750        760        770        780
orf58a.pep  EGIPHLLAPVVTDMKLAANALNWCVNEMEKRYRLMSFMGVRNLAGXNQKIAEAAARGEKI
            |||||||||||||||||||||||||||||||||||||||||||||| |||||||||||||
orf58-1     EGIPHLLAPVVTDMKLAANALNWCVNEMEKRYRLMSFMGVRNLAGFNQKIAEAAARGEKI
              730        740        750        760        770        780

790        800        810        820        830        840
orf58a.pep  GNPFSLTPDNPEPLXKLPFIVVVVDEFADLMMTAGKKIEELIARLAQKARAAGIHLILAT
            |||||||||:||||  ||||||||||||||||||||||||||||||||||||||||||||
orf58-1     GNPFSLTPDDPEPLEKLPFIVVVVDEFADLMMTAGKKIEELIARLAQKARAAGIHLILAT
              790        800        810        820        830        840

850        860        870        880        890        900
orf58a.pep  QRPSVDVITGLIKANIPTRIAFQVSSKIDSRTILDQMGAENLLGQGDMLFLPPGTAYPQR
            ||||||||||||||||||||||||||||||||||||||||||||||||||| ||||||||
orf58-1     QRPSVDVITGLIKANIPTRIAFQVSSKIDSRTILDQMGAENLLGQGDMLFLLPGTAYPQR
              850        860        870        880        890        900

910        920        930        940        950        960
orf58a.pep  VHGAFASDEEVHRVVEYLKQFGEPDYVDDXLSGGMSDDLLGISRSGDGETDPMYDEAVSV
            ||||||||||||||||||||||||||||| ||| ::| ||:|||||||||||||||||||
orf58-1     VHGAFASDEEVHRVVEYLKQFGEPDYVDDILSGGGSEELPGIGRSGDDETDPMYDEAVSV
              910        920        930        940        950        960

970        980        990       1000       1010
orf58a.pep  VLKTRKASISGVQRALRIGYNRAARLIDQMEAEGIVSAPEHNGNRTILVPXDNAX
            ||||||||||||||||||||||||||||||||||||||||||||||||||||||
orf58-1     VLKTRKASISGVQRALRIGYNRAARLIDQMEAEGIVSAPEHNGNRTILVPLDNAX
              970        980        990       1000       1010
```

Homology with a Predicted ORF from *N. gonorrhoeae*

ORF58 shows complete identity over a 9aa overlap with a predicted ORF (ORF58ng) from *N. gonorrhoeae*:

```
orf58.pep   ALMLFHAVKTAVYWLFVGVVRFCRNYLAHESEPDRPVPP                            103
                                           |||||||||
orf58-1                                    SEPDRPVPPASANRADVPTASDGYSDSGNG      30
```

The ORF58ng nucleotide sequence <SEQ ID 493> is predicted to encode a protein having partial amino acid sequence <SEQ ID 494>:

```
  1  ..SEPDRPVPPA SANRADVPTA SDGYSDSGNG TEEAETEAAE AAEEEAADTE

51    DIATAVIDNR RIPFDRSIAE GLMQSESKTS PVRPVFKEIT LEEATRALSS

101    AALRETKKRY IDAFEKNGTA VPKVRVSDTP MEGLQIIGLD DPVLQRTYSR

151    MFDADKEAFS ESADYGFEPY FEKQHPSAFS AVKAENARNA PFRRHAGQEK

201    GQAEAKSPDV SQGQSVSDGT AVRDARRRVS VNLKEPNKAT VSAEARISRL
```

```
251  IPESRTVVGK  RDVEMPSETE  NVFTETVSSV  GYGGPVYDEA  ADIHIEEPAA

301  PDAWVVEPPE  VPEVAVPEID  ILPPPPVSEI  YNRTYEPPAG  FEQAQRSRIA

351  ETDHLAADVL  NGGWQEETAA  IADDGSEGAA  ERSSGQYLSE  TEAFGHDSQA

401  VCPFEDVPSE  RPSCRVSDTE  ADEGAFQSEE  TGAVSEHLPT  TDLLLPPLFN

451  PEATQTEEEL  LENSITIEEK  LAEFKVKVKV  VDSYSGPVIT  RYEIEPDVGV

501  RGNSVLNLEK  DLARSLGVAS  IRVVETIPGK  TCMGLELPNP  KRQMIRLSEI

551  FNSPEFAESK  SKLTLALGQD  ITGQPVVTDL  GKAPHLLVAG  TTGSGKSVGV

601  NAMILSMLFK  AAPEDVRMIM  IDPKMLELSI  YEGITHLLAP  VVTDMKLAAN

651  ALNWCVNEME  KRYRLMSFMG  VRNLAGFNQK  IAEAAARGEK  IGNPFSLTPD

701  DPEPLEKLPF  IVVVVDEFAD  LMMTAGKKIE  ELIARLAQKA  RAAGIHLILA

751  TQRPSVDVIT  GLIKANIPTR  IAFQVSSKID  SRTILDQMGA  ENLLGQGDML

801  FLPPGTAYPQ  RVHGAFASDE  EVHRVVEYLK  QFGEPDYVDD  ILSGGGSEEL

851  PGIGRSGDGE  TDPMYDEAVS  VVLKTRKASI  SGVQRALRIG  YNRAARLIDQ

901  MEAEGIVSAP  EHNGNRTILV  PLDNA*
```

This partial gonococcal sequence contains a predicted transmembrane region and a predicted ATP/GTP-binding site motif A (P-loop; double underlined). Furthermore, it has a domain homologous to the FTSK cell division protein of *E. coli*. Alignment of ORF58ng and FtsK (accession number p46889) show a 65% amino acid identity in 459 overlap:

```
ORF58ng:  467  IEEKLAEFKVKVKVVDSYSGPVITRYEIEPDVGVRGNSVLNLEKDLARSLGVASIRVVET   526
               +E  LA+F++K VV+   GPVITR+E+    GV+   + NL +DLARSL  ++RVVE
FtsK:     868  VEARLADFRIKADVVNYSPGPVITRFELNLAPGVKAARISNLSRDLARSLSTVAVRVVEV   927

ORF58ng:  527  IPGKTCMGLELPNPKRQMIRLSEIFNSPEFAESKSKLLTALGQDITGQPVVTDLGKAPHL   586
               IPGK  +GLELPN KRQ + L E+ ++ +F ++ S LT+ LG+DI G+PVV DL K PHL
FtsK:     928  IPGKPYVGLELPNKKRQTVYLREVLDNAKFRDNPSPLTVVLGKDIAGEPVVADLAKMPHL   987

ORF58ng:  587  LVAGTTGSGKSVGVNAMILSMLFKAAPEDVRMIMIDPKMLELSIYEGITHLLAPVVTDMK   646
               LVAGTTGSGKSVGVNANILSML+KA PEDVR IMIDPKMLELS+YEGI HLL VVTDMK
FtsK:     988  LVAGTTGSGKSVGVNAMILSMLYKAQPEDVRFIMIDPKMLELSVYEGIPHLLTEVVTDMK   1047

ORF58ng:  647  LAANALNWCVNEMEKRYRLMSFMGVRNLAGFNQKIAEAAARGEKIGNPFSLTPDDPEP--   704
                AANAL WCVNEME+RY+LMS +GVRNLAG+N+KIAEA     I +P+    D  +
FtsK:     1048 DAANALRWCVNEMERRYKLMSALGVRNLAGYNEKIAEADRMMRPIPDPYWKPGDSMDAQH   1107

ORF58ng:  705  --LEKLPFIVVVVDEFADLMMTAGKKIEELIARLAQKARAAGIHLILATQRPSVDVITGL   762
                 L+K P+IVV+VDEFADLMMT GKK+EELIARLAQKARAAGIHL+LATQRPSVDVITGL
FtsK:     1108 PVLKKEPYIVVLVDEFADLMMTVGKKVEELIARLAQKARAAGIHLVLATQRPSVDVITGL   1167

ORF58ng:  763  IKANIPTRIAFQVSSKIDSRTILDQMGAENLLGQGDMLFLPPGTAYPQRVHGAFASDEEV   822
               IKANIPTRIAF VSSKIDSRTILDQ GAE+LLG GDML+  P +   P RVHGAF D+EV
FtsK:     1168 IKANIPTRIAFTVSSKIDSRTILDQAGAESLLGMGDMLYSGPNSTLPVRVHGAFVRDQEV   1227

ORF58ng:  823  HRVVEYLKQFGEPDYVDDILSGGGSEELPGIGRSGDGETDPMYDEAVSVVLKTRKASISG   882
               H VV+   K G P YVD I S    SE    G G   E DP++D+AV  V + RKASISG
FtsK:     1228 HAVVQDWKARGRPQYVDGITSDSESEGGAG-GFDGAEELDPLFDQAVQFVTEKRKASISG   1286

ORF58ng:  883  VQRALRIGYNRAARLIDQMEAEGIVSAPEHNGNRTILVP                      921
               VQR  RIGYNRAAR+I+QMEA+GIVS   HNGNR +L P
FtsK:     1287 VQRQFRIGYNRAARIIEQMEAQGIVSEQGHNGNREVLAP                      1325
```

Further work on ORF58ng revealed the complete gonococcal DNA sequence to be <SEQ ID 495>:

```
 1  ATGTTTTGGA  TAGTTTTGAT  CGTTATtgtg  TTGCTTGCGC  TTGCCGGCCT

51  GTTTTTTGTC  CGCGCACAAT  CCGAACGCGA  GTGGATGCGC  GAGGTTTCTG
```

-continued

```
 101 CGTGGCAGGA AAAGAAAGGG GAAAAACAGG CGGAGCTGCC TGAAATCAAA
 151 GACGGTATGC CCGATTTTCC CGAGTTTTCC CTGATGCTTT TCCATGCCGT
 201 CAAAACGGCA GTGTATTGGC TGTTTGTCGG TGTCGTCCGT TTCTGCCGAA
 251 ACTATCTGGC GCACGAATCC GAACCGGACA GGCCCGTTCC GCCTGCTTCT
 301 GCAAACCGTG CGGATGTTCC GACCGCATCC GACGGGTATT CAGACAGTGG
 351 AAACGGGACG GAAGAAGCGG AAACGGAAGC AGCAGAAGCT GCGGAGGAAG
 401 AGGCTGCCgA TACgGAAGAC ATTGCAACTG CCGTAATCGA CAACCGCCGC
 451 ATCCcatTCG ACCGGAGTAT TGCTGAAGGG TTGATGCAGT CTGAAAGCAA
 501 AACTTCGCCC GTCCGTCCGG TTTTTAAGGA AATCACTTTG GAAGAAGCAA
 551 CGCGTGCTTT AAGCAGCGCG GCTTTAAGGG AAACGAAAAA ACGCTATATC
 601 GATGCATTTG AGAAAAACGG AACAGCCGTC CCCAAAGTAC GCGTGTCCGA
 651 TACCCCGATG GAAGGGCTGC AGATTATCGG TTTGGACGAC CCTGTGCTTC
 701 AACGCACGTA TTCCCGTATG TTTGATGCGG ACAAAGAAGC GTTTTCCGAG
 751 TCTGCGGATT ACGGATTTGA GCCGTATTTT GAGAAGCAGC ATCCGTCTGC
 801 CTTTTCTGCA GTCAAAGCCG AAAATGCACG GAATGCGCCG TTCCGCCGTC
 851 ATGCAGGGCA GGAGAAAGGG CAGGCGGAGG CAAAATCCCC GGATGTTTCC
 901 CAAGGGCAGT CCGTTTCAGA CGGCACAGCC GTCCGCGATG CCCGCCGCCG
 951 CGTTTCCGTC AATTTGAAAG AACCGAACAA GGCAACGGTT TCTGCGGAGG
1001 CGCGGATTTC GCGCCTGATT CCGGAAAGTC GGACGGTTGT CGGGAAACGG
1051 GATGTCGAAA TGCCGTCTGA AACCGAAAAT GTTTTCACGG AAACCGTTTC
1101 GTCTGTGGGA TACGGCGGTC CGGTTTATGA TGAAGCTGCC GATATCCATA
1151 TTGAAGAGCC TGCCGCGCCC GATGCTTGGG TGGTCGAACC ACCCGAAGTG
1201 CCGGAGGTAG CCGTACCCGA AATCGATATT CTGCCGCCGC CTCCCGTATC
1251 GGAAATCTAC AACCGTACCT ATGAGCCGCC GGCAGGATTC GAGCAGGCGC
1301 AACGCAGCCG CATTGCCGAA ACCGACCATC TTGCCGCTGA TGTTTTGAAT
1351 GGAGGTTGGC AGGAGGAAAC CGCCGCTATT GCAGATGACG GCAGTGAGGG
1401 TGCGGCAGAG CGGTCAAGCG GGCAATATCT GTCGGAAACC GAAGCGTTCG
1451 GGCATGACAG TCAGGCGGTT TGTCCGTTTG AAGATGTGCC GTCTGAACGC
1501 CCGTCCTGCC GGGTATCGGA TACGGAAGCG GATGAAGGGG CGTTCCAATC
1551 GGAAGAGACC GGTGCGGTAT CCGAACACCT GCCGACAACC GACCTGCTTC
1601 TGCCTCCGCT GTTCAATCCC GAGGCGACGC AAACCGAAGA AGAACTGTTG
1651 GAAAACAGCA TCACCATCGA AGAAAATTG GCGGAGTTCA AAGTCAAGGT
1701 CAAGGTTGTC GATTCTTATT CCGGCCCCGT GATTACGCGT TATGAAATCG
1751 AACCCGATGT CGGCGTGCGC GGCAATTCCG TTCTGAATTT GGAAAAAGAC
1801 TTGGCGCGTT CGCTCGGCGT GGCTTCCATC CGCGTTGTCG AAACCATCCC
1851 CGGCAAAACC TGCATGGGTT TGGAACTTCC GAACCCGAAA CGCCAAATGA
1901 TACGCCTGAG CGAAATTTTC AATTCGCCCG AGTTTGCCGA ATCCAAATCC
1951 AAGCTGACGC TCGCGCTCGG TCAGGACATT ACCGGACAGC CCGTCGTAAC
2001 CGACTTGGGC AAAGCACCGC ATTTGCTGGT TGCCGGCACG ACCGGTTCGG
2051 GCAAATCGGT GGGTGTCAAC GCGATGATTC TGTCTATGCT TTTCAAAGCC
```

```
-continued
2101 GCGCCGGAAG ACGTGCGTAT GATTATGATC GATCCGAAAA TGCTGGAATT

2151 GAGCATTTAC GAAGGCATCA CGCACCTGCT CGCCCCTGTC GTTACCGATA

2201 TGAAGCTGGC GGCAAACGCG CTGAACTGGT GTGTTAACGA AATGGAAAAA

2251 CGCTACCGCC TGATGAGCTT TATGGGCGTG CGCAATCTTG CGGGCTTCAA

2301 CCAAAAAATC GCCGAAGCCG CAGCAAGGGG AGAAAAAATC GGCAATCCGT

2351 TCAGCCTCAC GCCCGACGAT CCCGAACCTT TGGAAAAACT GCCGTTTATC

2401 GTGGTCGTGG TCGATGAGTT TGCCGATTTG ATGATGACGG CAGGCAAGAA

2451 AATCGAAGAA CTGATTGCGC GCCTCGCCCA AAAAGCCCGC GCGGCAGGCA

2501 TCCACCTTAT CCTTGCCACA CAACGCCCCA GCGTCGATGT CATCACGGGT

2551 CTGATTAAGG CGAACATCCC GACGCGTATC GCGTTCCAAG TGTCCAGCAA

2601 AATCGACAGC CGCACGATTC TCGACCAAAT GGGCGCGGAA AACCTGCTCG

2651 GTCAGGGCGA TATGCTGTTC CTGCCGCCGG GTACTGCCTA TCCGCAGCGC

2701 GTTCACGGCG CGTTTGCCTC GGATGAAGAG GTGCACCGCG TGGTCGAATA

2751 TCTGAAGCAG TTTGGCGAGC CGGACTATGT TGACGATATT TTGAGCGGCG

2801 GCGGCAGCGA AGAGCTGCCC GGCATCGGGC GCAGCGGCGA CGGCGAAACC

2851 GATCCGATGT ACGACGAGGC CGTATCCGTT GTCCTGAAAA CGCGCAAAGC

2901 CAGCATTTCG GGCGTACAGC GCGCCTTGCG CATCGGCTAC AACCGCGCCG

2951 CGCGTCTGAT TGACCAAATG GAAGCGGAAG GCATTGTGTC CGCACCGGAA

3001 CACAACGGCA ACCGTACGAT TCTCGTCCCC TTGGACAATG CTTGA
```

This corresponds to the amino acid sequence <SEQ ID 496; ORF58ng-1>:

```
  1 MFWIVLIVIV LLALAGLFFV RAQSEREWMR EVSAWQEKKG EKQAELPEIK

51 DGMPDFPEFS LMLFHAVKTA VYWLFVGVVR FCRNYLAHES EPDRPVPPAS

101 ANRADVPTAS DGYSDSGNGT EEAETEAAEA AEEEAADTED IATAVIDNRR

151 IPFDRSIAEG LMQSESKTSP VRPVFKEITL EEATRALSSA ALRETKKRYI

201 DAFEKNGTAV PKVRVSDTPM EGLQIIGLDD PVLQRTYSRM FDADKEAFSE

251 SADYGFEPYF EKQHPSAFSA VKAENARNAP FRRHAGQEKG QAEAKSPDVS

301 QGQSVSDGTA VRDARRRVSV NLKEPNKATV SAEARISRLI PESRTVVGKR

351 DVEMPSETEN VFTETVSSVG YGGPVYDEAA DIHIEEPAAP DAWVVEPPEV

401 PEVAVPEIDI LPPPPVSEIY NRTYEPPAGF EQAQRSRIAE TDHLAADVLN

451 GGWQEETAAI ADDGSEGAAE RSSGQYLSET EAFGHDSQAV CPFEDVPSER

501 PSCRVSDTEA DEGAFQSEET GAVSEHLPTT DLLLPPLFNP EATQTEEELL

551 ENSITIEEKL AEFKVKVKVV DSYSGPVITR YEIEPDVGVR GNSVLNLEKD

601 LARSLGVASI RVVETIPGKT CMGLELPNPK RQMIRLSEIF NSPEFAESKS

651 KLTLALGQDI TGQPVVTDLG KAPHLLVAGT TGSGKSVGVN AMILSMLFKA

701 APEDVRMIMI DPKMLELSIY EGITHLLAPV VTDMKLAANA LNWCVNEMEK

751 RYRLMSFNGV RNLAGFNQKI AEAAARGEKI GNPFSLTPDD PEPLEKLPFI

801 VVVVDEFADL MMTAGKKIEE LIARLAQKAR AAGIHLILAT QRPSVDVITG

851 LIKANIPTRI AFQVSSKIDS RTILDQMGAE NLLGQGDMLF LPPGTAYFQR
```

```
 901 VHGAFASDEE VHRVVEYLKQ FGEPDYVDDI LSGGGSEELP GIGRSGDGET

951 DPMYDEAVSV VLKTRKASIS GVQRALRIGY NRAARLIDQM EAEGIVSAPE

1001 HNGNRTILVP LDNA*
```

ORF58ng-1 and ORF58-1 show 97.2% identity in 1014 aa overlap:

```
              10         20         30         40         50         60
orf58-1.pep  MFWIVLIVILLLALAGLFFVRAQSEREWMREVSAWQEKKGEKQAELPEIKDGMPDFPELA
             ||||||||:||||||||||||||||||||||||||||||||||||||||||||||||::
orf58ng-1    MFWIVLIVIVLLALAGLFFVRAQSEREWMREVSAWQEKKGEKQAELPEIKDGMPDFPEFS
              10         20         30         40         50         60
              70         80         90        100        110        120
orf58-1.pep  LMLFGAVKTAVYWLFVGVVRFCRNYLAHESEPDRPVPPASNRADVPTASDGYSDSGNGT
             |||||||||||||||||||||||||||||||||||||||||||||||||||||||||||
orf58ng-1    LMLFGAVKTAVYWLFVGVVRFCRNYLAHESEPDRPVPPASNRADVPTASDGYSDSGNGT
              70         80         90        100        110        120
             130        140        150        160        170        180
orf58-1.pep  EEAETEEAEAAEEEAADTEDIATAVIDNRRIPFDRSIAEGLMPSESEISPVRPVFKEITL
             ||||||||||||||||||||||||||||||||||||||||||:|||:|:|||||||||||
orf58ng-1    EEAETEAAEAAEEEAADTEDIATAVIDNRRIPFDRSIAEGLMQSESKTSPVRPVFKEITL
             130        140        150        160        170        180
             190        200        210        220        230        240
orf58-1.pep  EEATRALNSAALRETKKRYIDAFEKNETAVPKVRVSDTPMEGLQIIGLDDPVLQRTYSHM
             ||||||:|||||||||||||||||||:|||||||||||||||||||||||||||||:|
orf58ng-1    EEATRALSSAALRETKKRYIDAFEKNGTAVPKVRVSDTPMEGLQIIGLDDPVLQRTYSRM
             190        200        210        220        230        240
             250        260        270        280        290        300
orf58-1.pep  FDADKEAFSESADYGFEPYFEKQHPSAFSAVKAENARNAPFHRHAGOGKGQAEAKSPDVS
             ||||||||||||||||||||||||||||||||||||||||||:|||||:||||||||||
orf58ng-1    FDADKEAFSESADYGFEPYFEKQHPSAFSAVKAENARNAPFRRHAGEKGQAEAKSPDVS
             250        260        270        280        290        300
             310        320        330        340        350        360
orf58-1.pep  QGQSVSDGTAVRDARRRVSVNLKEPNKATVSAEARISRLIPESQTVVGKRDVEMPSETEN
             ||||||||||||||||||||||||||||||||||||||||||||:|||||||||||||||
orf58ng-1    QGQSVSDGTAVRDARRRVSVNLKEPNKATVSAEARISRLIPESRTVVGKRDVEMPSETEN
             310        320        330        340        350        360
             370        380        390        400        410        420
orf58-1.pep  VFTETVSSVGYGGPVYDETADIHIEEPAAPDAWVVEPPEVPKVPMTAIDIQPPPPVSEIY
             |||||||||||||||||:|||||||||||||||||||||||:|:|||||:|||||||||
orf58ng-1    VFTETVSSVGYGGPVYDEAADIHIEEPAAPDAWVVEPPEVPEAVPEIDILPPPPVSEIY
             370        380        390        400        410        420
             430        440        450        460        470        480
orf58-1.pep  NRTYEPPSGFEQVQRSRIAETDHLADDVLNGGWQEETAAIADDGSEGAAERSSGQYLSET
             ||||||||:|||||:||||||||||||||||||||||||||||||||||||||||||||
orf58ng-1    NRTYEPPAGFEQAQRSRIAETDHLAADVLNGGWQEETAAIADDGSEGAAERSSGQYLSET
             430        440        450        460        470        480
             490        500        510        520        530        540
orf58-1.pep  EAFGHDSQAVCPFENVPSERPSCRVSDTEADEGAFPSEETGAVSEHLPTTDLLLPPLFNP
             ||||||||||||||:|||||||||||||||||||:|||||||||||||||||||||||
orf58ng-1    EAFGHDSQAVCPFEDVPSERPSCRVSDTEADEGAFQSEETGAVSEHLPTTDLLLPPLFNP
             490        500        510        520        530        540
             550        560        570        580        590        600
orf58-1.pep  EATQTEEELLENSITIEEKLAEFKVKVKVVDSYSGPVITRYEIEPDVGVRGNSVLNLEKD
             |||||||||||||||||||||||||||||||||||||||||||||||||||||||||||
orf58ng-1    EATQTEEELLENSITIEEKLAEFKVKVKVVDSYSGPVITRYEIEPDVGVRGNSVLNLEKD
             550        560        570        580        590        600
             610        620        630        640        650        660
orf58-1.pep  LARSLGVASIRVVETIPGKTCMGLELPNPKRQMIRLSEIFNSPEFAESKSKLTLALGQDI
             |||||||||||||||||||||||||||||||||||||||||||||||||||||||||||
orf58ng-1    LARSLGVASIRVVETIPGKTCMGLELPNPKRQMIRLSEIFNSPEFAESKSKLTLALGQDI
             610        620        630        640        650        660
             670        680        690        700        710        720
orf58-1.pep  TGQPVVTDLGKAPHLLVAGTTGSGKSVGVNAMILSMLFKAAPEDVRMIMIDPKMLELSIY
             |||||||||||||||||||||||||||||||||||||||||||||||||||||||||||
orf58ng-1    TGQPVVTDLGKAPHLLVAGTTGSGKSVGVNAMILSMLFKAAPEDVRMIMIDPKMLELSIY
             670        680        690        700        710        720
             730        740        750        760        770        780
orf58-1.pep  EGITHLLAPVVTDMKLAANALNWCVNEMEKRYRLMSFMGVRNLAGFNQKIAEAAARGEKI
             |||||||||||||||||||||||||||||||||||||||||||||||||||||||||||
orf58ng-1    EGITHLLAPVVTDMKLAANALNWCVNEMEKRYRLMSFMGVRNLAGFNQKIAEAAARGEKI
             730        740        750        760        770        780
             790        800        810        820        830        840
orf58-1.pep  GNPFSLTPDDPEPLEKLPFIVVVVDEFADLMMTAGKKIEELIARLAQKARAAGIHLILAT
             |||||||||||||||||||||||||||||||||||||||||||||||||||||||||||
orf58ng-1    GNPFSLTPDDPEPLEKLPFIVVVVDEFADLMMTAGKKIEELIARLAQKARAAGIHLILAT
             790        800        810        820        830        840
```

```
                    850        860        870        880        890        900
orf58-1.pep   QRPSVDVITGLIKANIPTRIAFQVSSKIDSRTILDQMGAENLLGQGDMLFLLPPGTAYPQR
              ||||||||||||||||||||||||||||||||||||||||||||||||||||||||||||
orf58ng-1     QRPSVDVITGLIKANIPTRIAFQVSSKIDSRTILDQMGAENLLGQGDMLFLLPPGTAYPQR
                    850        860        870        880        890        900
                    910        920        930        940        950        960
orf58-1.pep   VHGAFASDEEVHRVVEYLKQFGEPDYVDDILSGGGSEELPGIGRSGDDETDPMYDEAVSV
              ||||||||||||||||||||||||||||||||||||||||||||||| ||||||||||||
orf58ng-1     VHGAFASDEEVHRVVEYLKQFGEPDYVDDILSGGGSEELPGIGRSGDGETDPMYDEAVSV
                    910        920        930        940        950        960
                    970        980        990        1000       1010
orf58-1.pep   VLKTRKASISGVQRALRIGYNRAARLIDQMEAEGIVSAPEHNGNRTILVPLDNAX
              ||||||||||||||||||||||||||||||||||||||||||||||||||||||
orf58ng-1     VLKTRKASISGVQRALRIGYNRAARLIDQMEAEGIVSAPEHNGNRTILVPLDNAX
                    970        980        990        1000       1010
```

Furthermore, ORF58ng-1 shows significant homology to the *E. coli* protein FtsK:

```
sp|P46889|FTSK_ECOLI CELL DIVISION PROTEIN FTSK >gi|1651412|gnl|PID|d1015290
(D1 division protein FtsK [Escherichia coli] >gi|1651418|gnl|PID|d1015296
(D90727) Cell division protein FtsK [Escherichia coli] >gi|1787117
(AE000191) cell division protein FtsK [Escherichia coli] Length = 1329
Score = 576 bits (1469), Expect = e - 163
Identities = 301/459 (65%), Positives = 353/459 (76%), Gaps = 5/459 (1%)

Query:   556 IEEKLAEFKVKVKVVDSYSGPVITRYEIEPDVGVRGNSVLNLEKDLARSLGVASIRVVET    615
             +E +LA+F++K VV+    GPVITR+E+    GV+  + NL +DLARSL   ++RVVE
Sbjct:   868 VEARLADFRIKADVVNYSPGPVITRFELNLAPGVKAARISNLSRDLARSLSTVAVRVVEV    927

Query:   616 IPGKTCMGLELPNPKRQMIRLSEIFNSPEFAESKSKLTLALGQDITGQPVVTDLGKAPHL    675
             IPGK  +GLELPN KRQ + L E+ ++ +F ++ S LT+ LG+DI G+PVV DL K PHL
Sbjct:   928 IPGKPYVGLELPNKKRQTVYLREVLDNAKFRDNPSPLTVVLGKDIAGEPVVADLAKMPHL    987

Query:   676 LVAGTTGSGKSVGVNAMILSMLFKAAPEDVRMIMIDPKMLELSIYEGITHLLAPVVTDMK    735
             LVAGTTGSGKSVGVNAMILSML+KA PEDVR IMIDPKMLELS+YEGI HLL  VVTDMK
Sbjct:   988 LVAGTTGSGKSVGVNAMILSMLYKAQPEDVRFIMIDPKMLELSVYEGIPHLLTEVVTDMK    1047

Query:   736 LAANALNWCVNEMEKRYRLMSFMGVRNLAGFNQKIAEAAARGEKIGNPFSLTPDDPEP--    793
              AANAL WCVNEME+RY+LMS +GVRNLAG+N+KIAEA     I +P+    D    +
Sbjct:  1048 DAANALRWCVNEMERRYKLMSALGVRNLAGYNEKIAEADRMMRPIPDPYWKPGDSMDAQH    1107

Query:   794 --LEKLPFIVVVVDEFADLMMTAGKKIEELIARLAQKARAAGIHLILATQRPSVDVITGL    851
               L+K P+IVV+VDEFADLMMT GKK+EELIARLAQKARAAGIHL+LATQRPSVDVITGL
Sbjct:  1108 PVLKKEPYIVVLVDEFADLMMTVGKKVEELIARLAQKARAAGIHLVLATQRPSVDVITGL    1167

Query:   852 IKANIPTRIAFQVSSKIDSRTILDQMGAENLLGQGDMLFLPPGTAYPQRVHGAFASDEEV    911
             IKANIPTRIAF VSSKIDSRTILDQ GAE+LLG GDML+ P +  P RVHGAF D+EV
Sbjct:  1168 IKANIPTRIAFTVSSKIDSRTILDQAGAESLLGMGDMLYSGPNSTLPVRVHGAFVRDQEV    1227

Query:   912 HRVVEYLKQFGEPDYVDDILSGGGSEELPGIGRSGDGETDPMYDEAVSVVLKTRKASISG    971
             H VV+  K G P YVD I S     SE    G G   E DP++D+AV  V + RKASISG
Sbjct:  1228 HAVVQDWKARGRPQYVDGITSDSESEGGAG-GFDGAEELDPLFDQAVQFVTEKRKASISG    1286

Query:   972 VQRALRIGYNRAARLIDQMEAEGIVSAPEHNGNRTILVP                        1010
             VQR  RIGYNRAAR+I+QMEA+GIVS   HNGNR +L P
Sbjct:  1287 VQRQFRIGYNRAARIIEQMEAQGIVSEQGHNGNREVLAP                        1325
```

Based on this analysis, it is predicted that the proteins from *N. meningitidis* and *N. gonorrhoeae*, and their epitopes, could be useful antigens for vaccines or diagnostics, or for raising antibodies.

Example 59

The following partial DNA sequence was identified in *N. meningitidis* <SEQ ID 497>:

```
  1 ATGATTATC AAAGAAACCT CATCAAAGAA CTCTCTTTTA CCGCCGTCGG

51 CATTTTCGTC GTCCTCTTGG CGGTATTGGT CTCCACGCAG GCAATCAACC
```

```
 101 TGCTCGGCCG TGCCGCCGAC GGGC..GTGA TCGCCATCGA TGCCGTGTTG

151 GCATTGGTCG GCTTCTGGGT C.......... .......... ..........

//

901 .........A TTGCCATCGG TTTGTTTTTA ATTTACCAAA ACGGGCTGAC

951 CCTGCTTTTT GAAGCCGTGG AAGACGGCAA AATCCATTTT TGGCTCGGAC

1001 TGCTGCCTAT GCACATTATC ATGTTTGTCC TTGCACTCAT CCTGTTGCGC

1051 GTCCGCAGTA TGCCCAGCCA GCCCTTCTGG CAGGCGGTTG GCAAAAGTCT

1101 GACATTGAAA GGCGGAAAAT GA
```

This corresponds to the amino acid sequence <SEQ ID 498; ORF101>:

```
  1 MIYQRNLIKE LSFTAVGIFV VLLAVLVSTQ AINLLGRAAD GXVIAIDAVL

51 ALVGFWV... .......... .......... .......... ..........

//

301 ...IAIGLFL IYQNGLTLLF EAVEDGKIHF WLGLLPMHII MFVLALILLR

351 VRSMPSQPFW QAVGKSLTLK GGK*
```

Further work revealed the complete nucleotide sequence <SEQ ID 499>:

```
   1 ATGATTTATC AAAGAAACCT CATCAAAGAA CTCTCTTTTA CCGCCGTCGG

51 CATTTTCGTC GTCCTCTTGG CGGTATTGGT CTCCACGCAG GCAATCAACC

101 TGCTCGGCCG TGCCGCCGAC GGGCGTGTCG CCATCGATGC CGTGTTGGCA

151 TTGGTCGGCT TCTGGGTCAT CGGTATGACG CCGCTTTTGC TGGTGTTGAC

201 CGCATTTATC AGTACGTTGA CCGTGTTGAC CCGCTACTGG CGCGACAGCG

251 AAATGTCGGT CTGGCTATCC TGCGGATTGG CATTGAAACA ATGGATACGC

301 CCGGTGATGC AGTTTGCCGT GCCGTTTGCC GTTTTGGTTG CCGTCATGCA

351 GCTTTGGGTG ATACCGTGGG CAGAGCTACG CAGCCGCGAA TACGCTGAAA

401 TCCTGAAGCA GAAGCAGGAA TTGTCTTTGG TGGAGGCAGG CGAGTTCAAC

451 AGTTTGGGCA AGCGCAACGG CAGGGTTTAT TTTGTCGAAA CCTTCGATAC

501 CGAATCCGGC ATCATGAAAA ACCTGTTCCT GCGCGAACAG GACAAAAACG

551 GCGGCGACAA CATCATCTTC GCCAAAGAAG GTAACTTCTC GCTGAACGAC

601 AACAAACGCA CGCTCGAATT GCGCCACGGC TACCGTTACA GCGGCACGCC

651 CGGACGCGCC GACTACAATC AGGTTTCCTT CCAAAAACTC AACCTGATTA

701 TCAGCACCAC GCCCAAACTC ATCGACCCCG TTTCCCACCG CCGTACCATT

751 CCGACCGCCC AACTGATTGG CAGCAGCAAC CCGCAACATC AGGCGGAATT

801 GATGTGGCGC ATCTCGCTGA CCGTCAGCGT CCTCCTACTC TGCCTGCTTG

851 CCGTGCCGCT TCCTATTTC AACCCGCGCA GCGGACATAC CTACAATATC

901 TTGATTGCCA TCGGTTTGTT TTTAATTTAC CAAAACGGGC TGACCCTGCT

951 TTTTGAAGCC GTGGAAGACG GCAAAATCCA TTTTTGGCTC GGACTGCTGC
```

-continued

```
1001 CTATGCACAT TATCATGTTT GCCGTTGCAC TCATCCTGTT GCGCGTCCGC

1051 AGTATGCCCA GCCAGCCCTT CTGGCAGGCG GTTGGCAAAA GTCTGACATT

1101 GAAAGGCGGA AAATGA
```

This corresponds to the amino acid sequence <SEQ ID 500; ORF101-1>:

```
  1 MIYQRNLIKE LSFTAVGIFV VLLAVLVSTQ AINLLGRAAD GRVAIDAVLA

51 LVGFWVIGMT PLLLVLTAFI STLTVLTRYW RDSEMSVWLS CGLALKQWIR

101 PVMQFAVPFA VLVAVMQLWV IPWAELRSRE YAEILKQKQE LSLVEAGEFN

151 SLGKRNGRVY FVETFDTESG IMKNLFLREQ DKNGGDNIIF AKEGNFSLND

201 NKRTLELRHG YRYSGTPGRA DYNQVSFQKL NLIISTTPKL IDPVSHRRTI

251 PTAQLIGSSN PQHQAELMWR ISLTVSVLLL CLLAVPLSYF NPRSGHTYNI

301 LIAIGLFLIY QNGLTLLFEA VEDGKIHFWL GLLPMHIIMF AVALILLRVR

351 SMPSQPFWQA VGKSLTLKGG K*
```

Computer analysis of this amino acid sequence gave the following results:

Homology with a Predicted ORF from *N. meningitidis* (Strain A)

ORF101 shows 91.2% identity over a 57aa overlap and 95.7% identity over a 69aa overlap with an ORF (ORF101a) from strain A of *N. meningitidis*:

```
                      10         20         30         40         50
orf101.pep   MIYQRNLIKELSFTAVGIFVVLLAVLVSTQAINLLGRAADGXVIAIDAVLALVGFWVX
             |||||||||||||||||||||||||||||||||||||| |||  ||||||||||||||
orf101a      MIYQRNLIKELSFTAVGIFVVLLAVLVSTQAINLLGXAADXRX-AIDAVLALVGFWVXXM
                      10         20         30         40         50
                                            //
                                                  90        100        110
orf101.pep   ..........................IAIGLFLIYQNGLTLLFEAVEDGKIHFWLGL
                                       |||||||||||||||||||||||||||||||
orf101a      LTVSVLLLCLLAVPLSYFNPRSGHTYNILXAIGLFLIYQNGLTLLLFEAVEDGKIHFWLGL
                    280        290        300        310        320        330
                     120        130        140        150
orf101.pep   LPMHIIMFVLALILLRVRSMPSQPFWQAVGKSLTLKGGKX
             |||||||||:|::|||||||||||||||||||||||||||
orf101a      LPMHIIMFVIAIVLLRVRSMPSQPFWQAVGKSLTLKGGKX
                    340        350        360        370
```

The complete length ORF101a nucleotide sequence <SEQ ID 501> is:

```
  1 ATGATTTATC AAAGAAACCT CATCAAAGAA CTCTCTTTTA CCGCCGTCGG

51 CATTTTCGTC GTCCTCTTGG CGGTATTGGT CTCCACGCAG GCAATCAACC

101 TGCTCGGCCN TGCCGCCGAC NGGCGTNTCG CCATCGATGC CGTGTTGGCA

151 TTGGTCGGCT TCTGGGTCNN NNGNATGACG CCGCTTTTGC TNGTGTTGAC

201 CGCATTTATC AGTACGTTGA CCGTGTTGAC CCGCTACTGG CGNGACAGCG

251 AAATGTCGGT CTGGNTATCC TGCGGATTGG CATTGAAACA ATGGATACGC
```

```
                                -continued
 301 CCGGTGATGC AGTTTGCCGT GCCGTTTGCC GTTTTGGTTG CCGTCATGCA

351 GCTTTGGGTG ATACCGTGGG CAGAGCTACG CAGCCGCGAA TACGCTGAAA

401 TCCTGAAGCA GAAGCAGGAA TTGTCTTTGG TGGAGGCAGG CGGGTTCAAC

451 AGTTTGGGCA AGCGCAACGG CAGGGTTTAT TTTGTCGAAA CCTTCGATAC

501 CGAATCCGGC ATCATGAAAA ACCTGTTCCT GCGCGAACAG GACAAAAACG

551 GCGGCGACAA CATCATCTTC NCCAAAGAAA GTAACTTCTC GCTGAACGAC

601 AACAAACGCA CGCTCGAATT GCGCCACGGC TACCGTTACA GCGGCACGCC

651 CGGACGCGCC GACTACAATC AGGTTTCCTT CCNAAAACTC AACCTGATTA

701 TCAGCACCAC GCCCAAACTC ATCGACCCCG TTTCCCACCG CCGTACNATN

751 CCNACNGCCC AACTGATTGG CAGCAGCAAC CCGCAACATC ANGCGGAATT

801 GATGTGGCGC ATCTCGCTGA CCGTCAGCGT CCTCCTACTC TGCCTGCTTG

851 CCGTGCCGCT TTCCTATTTC AACCCGCGCA GCGGACATAC CTACAATATC

901 TTGANTGCCA TCGGTTTGTT TTTAATTTAC CAAAACGGGC TGACCCTGCT

951 TTTTGAAGCC GTGGAAGACG GCAAAATCCA TTTTTGGCTC GGACTGCTGC

1001 CTATGCACAT CATCATGTTC GTCATCGCAA TCGTACTTCT GCGCGTCCGC

1051 AGCATGCCCA GCCAGCCCTT CTGGCAGGCG GTTGGCAAAA GTCTGACATT

1101 GAAAGGCGGA AAATGA
```

This encodes a protein having amino acid sequence <SEQ ID 502>:

```
  1 MIYQRNLIKE LSFTAVGIFV VLLAVLVSTQ AINLLGXAAD XRXAIDAVLA

51 LVGFWVXXMT PLLLVLTAFI STLTVLTRYW RDSEMSVWXS CGLALKQWIR

101 PVMQFAVPFA VLVAVMQLWV IPWAELRSRE YAEILRQKQE LSLVEAGGFN

151 SLGKRNGRVY FVETFDTESG IMKNLFLREQ DKNGGDNIIF XKESNFSLND

201 NKRTLELRHG YRYSGTPGRA DYNQVSFXKL NLIISTTPKL IDPVSHRRTX

251 PTAQLIGSSN PQHXAELMWR ISLTVSVLLL CLLAVPLSYF NPRSGHTYNI

301 LXAIGLFLIY QNGLTLLFEA VEDGKIHFWL GLLPMHIIMF VIAVLLRVR

351 SMPSQPFWQA VGKSLTLKGG K*
```

ORF101a and ORF101-1 show 95.4% identity in 371 aa overlap:

```
orf101a.pep  MIYQRNLIKELSFTAVGIFVVLLAVLVSTQAINLLGXAADXRXAIDAVLALVGFWVXXMT   60
             ||||||||||||||||||||||||||||||||||||  | || ||||||||||||| ||
orf101-1     MIYQRNLIKELSFTAVGIFVVLLAVLVSTQAINLLGRAADGRVAIDAVLALVGFWVIGMT   60 orf101a.pep  PLLLVLTAFISTLTVLTRYWRDSEMSVWXSCGLALKQWIRPVMQFAVPFAVLVAVMQLWV  120
             |||||||||||||||||||||||||||| |||||||||||||||||||||||||||||
orf101-1     PLLLVLTAFISTLTVLTRYWRDSEMSVWLSCGLALKQWIRPVMQFAVPFAVLVAVMQLWV  120 orf101a.pep  IPWAELRSREYAEILRQKQELSLVEAGGFNSLGKRNGRVYFVETFDTESGIMKNLFLREQ  180
             ||||||||||||||||||||||||||| ||||||||||||||||||||||||||||||
orf101-1     IPWAELRSREYAEILRQKQELSLVEAGEFNSLGKRNGRVYFVETFDTESGIMKNLFLREQ  180 orf101a.pep  DKNGGDNIIFXKESNFSLNDNKRTLELRHGYRYSGTPGRADYNQVSFXKLNLIISTTPKL  240
             ||||||||||  : ||||||||||||||||||||||||||||||||  |||||||||||
orf101-1     DKNGGDNIIFAKEGNFSLNDNKRTLELRHGYRYSGTPGRADYNQVSFQKLNLIISTTPKL  240 orf101a.pep  IDPVSHRRTXPTAQLIGSSNPQHXAELMWRISLTVSVLLLCLLAVPLSYFNPRSGHTYNI  300
             |||||||||||||||||||||| |||||||||||||||||||||||||||||||||||
orf101-1     IDPVSHRRTIPTAQLIGSSNPQHQAELMWRISLTVSVLLLCLLAVPLSYFNPRSGHTYNI  300
```

```
orf101a.pep  LXAIGLFLIYQNGLTLLFEAVEDGKIHFWLGLLPMHIIMFVIAIVLLRVRSMPSQPFWQA  360
             |||||||||||||||||||||||||||||||||||||||||||:::|||||||||||||
orf101-1     LIAIGLFLIYQNGLTLLFEAVEDGKIHFWLGLLPMHIIMFAVALILLRVRSMPSQPFWQA  360 orf101a.pep  VGKSLTLKGGK  371
             |||||||||||
orf101-1     VGKSLTLKGGK  371
```

Homology with a Predicted ORF from *N. gonorrhoeae* 10

ORF101 shows 96.5% identity in 57aa overlap at the N-terminal domain and 95.1% identity in 61 aa overlap at the C-terminal domain, respectively, with a predicted ORF (ORF101ng) from *N. gonorrhoeae*:

```
orf101.pep  MIYQRNLIKELSFTAVGIFVVLLAVLVSTQAINLLGRAADGXVIAIDAVLALVGFWV       57
            ||||||||||||||||||||||||||||||||||||||||| ||||||||||||||
orf101ng    MIYQRNLIKELSFTAVGIFVVLLAVLVSTQAINLLGRAADGRV-AIDAVLALVGFWVIGM  59
                                              //
orf101.pep                                      IAIGLFLIYQNGLTLLFEAVEDGKIHFWLG  333
                                                |||||||||||||||||||||||||||||
orf101ng    SLTVSVLLLCLLAVPLSYFNPRSGHTYNILIAIGLFLIYQNGLTLLFEAVEDGKIHFWLG  331 orf101.pep  LLPMHIIMFVLALILLRVRSMPSQPFWQAVGKSLTLKGGK  373
            |||||||||:|::|||||||||||||||||||
orf101ng    LLPMHIIMFVIAIVLLRVRSMPSQPFWQAVG           362
```

The ORF101ng nucleotide sequence <SEQ ID 503> is predicted to encode a protein having partial amino acid sequence <SEQ ID 504>:

```
  1 MIYQRNLIKE LSFTAVGIFV VLLAVLVSTQ AINLLGRAAD GRVAIDAVLA
 51 LVGFWVIGMT PLLLVLTAFI STLTVLTRYW RDSEMSVWLS CGLALKQWIR
101 PVMQFAVPFA ILIAVMQLWV IPWAELRSRE YAEILKQKQE LSLVEAGEFN
151 NLGKRNGRVY FVETFDTESG IMKNLFLREQ DKNGGDNIIF AKEGNFSLKD
201 NKRTLELRHG YRYSGTPGRA DYNQVSFQKL NLIISTTPKL IDPVSHRRTI
251 STAQLIGSSN PQHQAELMWR ISLTVSVLLL CLLAVPLSYF NPRSGHTYNI
301 LIAIGLFLIY QNGLTLLFEA VEDGKIHFWL GLLPMHIIMF VIAIVLLRVR
351 SMPSQPFWQA VG...
```

Further work revealed the complete nucleotide sequence <SEQ ID 505>:

```
  1 ATGATTTATC AAAGAAACCT CATCAAAGAA CTCTCTTTTA CCGCCGTCGG
 51 CATTTTCGTC GTCCTCTTGG CGGTGTTGGT GTCCACGCAG GCGATCAACC
101 TGCTTGGCCG CGCAGCTGAC GGGCGTGTCG CCATCGATGC CGTGTTGGCC
151 TTAGTCGGCT TCTGGGTCAT CGGTATGACC CCGCTTTTGC TGGTGTTGAC
201 CGCATTCATC AGCACGCTGA CCGTATTGAC CCGCTACTGG CGCGACAGCG
251 AAATGTCGGT CTGGCTATCC TGCGGATTGG CGTTGAAACA GTGGATACGC
301 CCCGTCATGC AGTTTGCCGT GCCGTTTGCC ATCCTGATTG CCGTCATGCA
351 GCTTTGGGTG ATACCGTGGG CAGAGCTGCG CAGCCGCGAA TATGCCGAAA
401 TTTTGAAGCA GAAGCAGGAA TTGTCTTTGG TGGAAGCCGG CGAGTTCAAT
```

-continued

```
 451 AACTTGGGCA AGCGCAACGG CAgggtttaT TtcgtcgaaA CCTTTGACAC
 501 CGaatccgGC ATCATGAAAA ACCTGTtcct GcGCGAACAG GACAAAAACG
 551 gcggcgacaA CATCATCTTC GCcaaaGAag gtaactTctc gctgaaggaC
 601 AACAAAcgca cgctcgaATT GCGCCACGGC TACCGTTACA GCGGcacgcC
 651 CGGacGCGCc gactaCAATC AGGTTtcctt cCAAAAacTc aacctgATta
 701 TCAGCACCAC GCCCAAacTT ATCGaccCCG TTTCCCACCG CCGCACCATT
 751 tcgacCGCCC AAcTGATTGG CAGCAGCAAT CCGCAACATC AGGCAGAATT
 801 GATGTGGCGC ATCTCGCTGA CCGTCAGCGT CCTCCTGCTC TGCCTACTCG
 851 CCGTGCCGCT TTCCTATTTC AACCCGCGCA GCGGACATAC CTACAATATC
 901 TTGATTGCCA TCGGTTTGTT TTTAATTTAC CAAAACGGGC TGACCCTGCT
 951 TTTTGAAGCC GTGGAAGACG GCAAAATCCA TTTTTGGCTC GGACTGCTGC
1001 CTATGCACAT CATCATGTTC GTCATCGCAA TCGTACTTCT GCGCGTCCGC
1051 AGTATGCCCA GCCAGCCCTT CTGGCAGGCG GTTGGCAAAA GTCTGACATT
1101 GAAAGgcgGA AAATGA
```

This corresponds to the amino acid sequence <SEQ ID 506; ORF101ng-1>:

```
  1 MIYQRNLIKE LSFTAVGIFV VLLAVLVSTQ AINLLGRAAD GRVAIDAVLA
 51 LVGFWVTGMT PLLLVLTAFI STLTVLTRYW RDSEMSVWLS CGLALKQWIR
101 PVMQFAVPFA ILIAVMQLWV IPWAELRSRE YAEILKQKQE LSLVEAGEFN
151 NLGKRNGRVY FVETFDTESG IMKNLFLREQ DKNGGDNIIF AKEGNFSLKD
201 NKRTLELRHG YRYSGTPGRA DYNQVSFQKL NLIISTTPKL IDPVSHRRTI
251 STAQLIGSSN PQHQAELMWR ISLTVSVLLL CLLAVPLSYF NPRSGHTYNI
301 LIAIGLFLIY QNGLTLLFEA VEDGKIHFWL GLLPMHIIMF VIAIVLLRVR
351 SMPSQPFWQA VGKSLTLKGG K*
```

ORF101ng-1 and ORF101-1 show 97.6% identity in 371 aa overlap:

```
                  10         20         30         40         50         60
   orf101-1.pep MIYQRNLIKELSFTAVGIFVVLLAVLVSTQAINLLGRAADGRVAIDAVLALVGFWVIGMT
                ||||||||||||||||||||||||||||||||||||||||||||||||||||||||||||
      orf101ng-1 MIYQRNLIKELSFTAVGIFVVLLAVLVSTQAINLLGRAADGRVAIDAVLALVGFWVIGMT
                  10         20         30         40         50         60

70         80         90        100        110        120
   orf101-1.pep PLLLVLTAFISTLTVLTRYWRDSEMSVWLSCGLALKQWIRPVMQFAVPFAVLVAVMQLWV
                ||||||||||||||||||||||||||||||||||||||||||||||||||:|||||||||
      orf101ng-1 PLLLVLTAFISTLTVLTRYWRDSEMSVWLSCGLALKQWIRPVMQFAVPFAILIAVMQLWV
                  70         80         90        100        110        120

130        140        150        160        170        180
   orf101-1.pep IPWAELRSREYAEILKQKQELSLVEAGEFNSLGKRNGRVYFVETFDTESGIMKNLFLREQ
                ||||||||||||||||||||||||||||||:|||||||||||||||||||||||||||||
      orf101ng-1 IPWAELRSREYAEILKQKQELSLVEAGEFNNLGKRNGRVYFVETFDTESGIMKNLFLREQ
                 130        140        150        160        170        180

190        200        210        220        230        240
   orf101-1.pep DKNGGDNIIFAKEGNFSLNDNKRTLELRHGYRYSGTPGRADYNQVSFQKLNLIISTTPKL
                ||||||||||||||||||:|||||||||||||||||||||||||||||||||||||||||
      orf101ng-1 DKNGGDNIIFAKEGNFSLKDNKRTLELRHGYRYSGTPGRADYNQVSFQKLNLIISTTPKL
                 190        200        210        220        230        240
```

```
                     250        260        270        280        290        300
orf101-1.pep  IDPVSHRRTIPTAQLIGSSNPQHQAELMWRISLTVSVLLLCLLAVPLSYFNPRSGHTYNI
              ||||||||||||||||||||||||||||||||||||||||||||||||||||||||||||
orf101ng-1    IDPVSHRRTISTAQLIGSSNPQHQAELMWRISLTVSVLLLCLLAVPLSYFNPRSGHTYNI
                     250        260        270        280        290        300
                     310        320        330        340        350        360
orf101-1.pep  LIAIGLFLIYQNGLTLLFEAVEDGKIHFWLGLLPMHIIMFAVALILLRVRSMPSQPFWQA
              |||||||||||||||||||||||||||||||||||||||||:::::|||||||||||||
orf101ng-1    LIAIGLFLIYQNGLTLLFEAVEDGKIHFWLGLLPMHIIMFVIAIVLLRVRSMPSQPFWQA
                     310        320        330        340        350        360
                     370
orf101-1.pep  VGKSLTLKGGKX
              ||||||||||||
orf101ng-1    VGKSLTLKGGKX
                     370
```

Based on this analysis, including the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 60

The following partial DNA sequence was identified in *N. meningitidis* <SEQ ID 507>:

```
  1  ..GGTGGTGGTT TTATCAATGC TTCCTGTGCC ACTTTGACGA CAGCCAAACC

51    GCAATATCAA GCAGGAGACC TTAGCGCTTT TAAGATAAGG CAAGGCAATG

101    TTGTAATCGC CGGACACGGT TTGGATGCAC GTGATACCGA TTACACACGT

151    ATTCTCAGTT ATCATTCCAA AATCGATGCA CCCGTATGGG GACAAGATGT

201    TCGTGTCGTC GCGGGACAAA ACGATGTGGC CGCAACAGGT GATGCACATT

251    CGCCTATTCT CAATAATGCT GCTGCCAATA CGTCAAACAA TACAGCCAAC

301    AACGGCACAC ATATCCCTTT ATTTGCGATT GATACAGGCA AATTAGGAGG

351    TAT.GTATGC CAACAAAATC ACCTTGATCA GTACGGTCGA GCAAGCAGGC

401    ATTCGTAA
```

This corresponds to the amino acid sequence <SEQ ID 508; ORF113>:

```
  1  ..GGGFINASCA TLTTAKPQYQ AGDLSAFKIR QGNVVIAGHG LDARDTDYTR

51    ILSYHSKIDA PVWGQDVRVV AGQNDVAATG DAHSPILNNA AANTSNNTAN

101    NGTHIPLFAI DTGKLGGXVC QQNHLDQYGR ASRHS*
```

Computer analysis of this amino acid sequence gave the following results:

Homology with pspA Putative Secreted Protein of *N. meningitidis* (Accession AF030941)

ORF and pspA show 44% aa identity in 179aa overlap:

```
orf113  GGGFINASCATLTTAKPQYQAGDLSAFKIRQGNVVIAGHGLDARDTDYTRILSYHSKIDA   60
        GGG INA+  TLT+    P     G+L+ F +  G VVI G GLD   D DYTRILS  ++I+A
pspa    GGGLINAASVTLTSGVPVLNNGNLTGFDVSSGKVVIGGKGLDTSDADYTRILSRAAEINA  256
```

```
orf113  PVWGQDVRVVAGQNDVAATGDAHSPILXXXXXXXXXXXXXXXGTHIPLFAIDTGKLGGMYA  120
            VWG+DV+VV+G+N +    G                   +  P  AIDT  LGGMYA
pspa    GVWGKDVKVVSGKNKLDFDG---------SLAKTASAPSSSDSVTPTVAIDTATLGGMYA  307 orf113  NKITLISTVEQAGIRNQGQWFASAGNVAVNAEGKLVNTGMIAATGENHAVSLHARNVHN  179
            +KITLIST    A IRN+G+ FA+ G V ++A+GKL N+G I A       +++ A+ V N
pspa    DKITLISTDNGAVIRNKGRIFAATGGVTLSADGKLSNSGSIDAA----EITISAQTVDN  362
```

Homology with a Predicted ORF from *N. gonorrhoeae*

ORF113 shows 86.5% identity in 52aa overlap at the N-terminal part and 94.1% identity in 17aa overlap at the C-terminal part with a predicted ORF (ORF113ng) from *N. gonorrhoeae*:

```
orf113                           GGGFINASCATLTTAKPQYQAGDLSAFKIR  30
                                 |||||||  |||| ::|||||| : ||||
orf113ng SHPSQLNGYIEVGGRRAEVVIANPAGIAVNGGGFINASRATLTTGQPQYQAGDFSGFKIR  224
orf113   QGNVVIAGHGLDARDTDYTRILSYHSKIDAPVWGQDVRVVAGQNDVAATGDAHSPILNNA  90
         |||:||||||||||||| |||||  ||||
orf113ng QGNAVIAGHGLDARDTDFTRILVCQQNHLDQYGRTSRHS  263
orf113                        IDTGKLGGXVCQQNHLDQYGRASRHS  135
                              |||||||||||||:||||
orf113ng DFSGFKIRQGNAVIAGHGLDARDTDFTRILVCQQNHLDQYGRTSRHS  263
```

The complete length ORF113ng nucleotide sequence <SEQ ID 509> is predicted to encode a protein having amino acid sequence <SEQ ID 510>:

```
  1 MNKTLYRVIF NRKRGAVVAV AETTKREGKS CADSGSGSVY VKSVSFIPTH

51 SKAFCFSALG FSLCLALGTV NIAFADGIIT DKAAPKTQQA TILQTGNGIP

101 QVNIQTPTSA GVSVNQYAQF DVGNRGAILN NSRSNTQTQL GGWIQGNPWL

151 TRGEARVVVN QINSSHPSQL NGYIEVGGRR AEVVIANPAG IAVNGGGFIN

201 ASRATLTTGQ PQYQAGDFSG FKIRQGNAVI AGHGLDARDT DFTRILVCQQ

251 NHLDQYGRTS RHS*
```

Based on this analysis, it is predicted that these proteins from *N. meningitidis* and *N. gonorrhoeae*, and their epitopes, could be useful antigens for vaccines or diagnostics, or for raising antibodies.

Example 61

The following partial DNA sequence was identified in *N. meningitidis* <SEQ ID 511>:

```
  1 ..TCAACGGGAC ATAGCGAACA AAATTACACT TGCCGCGAG AAATCACACG

51   CAACATTTCA CTGGGTTCAT TGCCTATGA ATCGCATCGC AAAGCATTAA

101   GCCATCATGC GCCCAGCCAA GGCACTGAGT TGCCGCAAAG CAACGGTATT

151   TCGCTACCCT ATACGTCCAA TTCTTTTACC CCATTACCCA GCAGCAGCTT

201   ATACATTATC AATCCTGTCA ATAAAGGCTA TCTTGTTGAA ACCGATCCAC

251   GCTTTGCCAA CTACCGTCAA TGGTTGGGTA GTGACTATAT GCtGGACAGC

301   CTCAAACTAG ACCCAAACAA TTTACATAAA CGTTTGGGTG ATGGTTATTA

351   CGAGCAACGT TTAATCAATG AACAAATCGC AGAGCTGACA GGGCATCGTC
```

```
401  GTTTAGAcGG TTATCAAAAC GACGAAGAAC AATTTAAAGC CTTAATGGAT
451  AATGGCGCGA CTGCGGCACG TTcGATGAAT CTCAGCGTTG GCATTGCATT
501  AAGTGCCGAG CAAGTAGCGC AACTGACCAG CGATATTGTT TGGTTGGTAC
551  AAAAAGAAGT TAAGCTTCCT GATGGCGGCA CACAAACCGT ATTGGTGCCA
601  CAGGTTTATG TACGCGTTAA AAATGGCGAC ATAGACGGTA AAGGTGCATT
651  GTTGTCAGGC AGCAATACAC AAATCAATGT TCAGGCAGC CTGAAAAACT
701  CAGGCACGAT TGCAGGgCGC AATGCGCTTA TTATCAATAC CGATACGCTA
751  GACAATATCG GTGGGCGTAT TCATGCGCAA AAATCAGCGG TTACGGCCAC
801  ACAAGACATC AATAATATTG GCGGCATGCT TTCTGCCGAA CAGACATTAT
851  TGCTCAACGC AGGCAACAAC ATCAACAGCC AAAGCACCAC CGCCAGCAGT
901  CAAAATACAC AAGGCAGCAG CACCTACCTA GACCGAATGG CAGGTATTTA
951  TATCACAGGC AAAGAAAAAG GTGTTT..
```

This corresponds to the amino acid sequence <SEQ ID 512; ORF115>:

```
  1 ..STGHSEQNYT LPREITRNIS LGSFAYESHR KALSHHAPSQ GTELPQSNGI
 51   SLPYTSNSFT PLPSSSLYII NPVNKGYLVE TDPRFANYRQ WLGSDYMLDS
101   LKLDPNNLHK RLGDGYYEQR LINEQIAELT GHRRLDGYQN DEEQFKALMD
151   NGATAARSMN LSVGIALSAE QVAQLTSDIV WLVQKEVKLP DGGTQTVLVP
201   QVYVRVKNGD IDGKGALLSG SNTQINVSGS LKNSGTIAGR NALIINTDTL
251   DNIGGRIHAQ KSAVTATQDI NNIGGMLSAE QTLLLNAGNN INSQSTTASS
301   QNTQGSSTYL DRMAGIYITG KEKGV..
```

Computer analysis of this amino acid sequence gave the following results:

Homology with the pspA Putative Secreted Protein of *N. meningitidis* (Accession Number AF030941)

ORF115 and pspA protein show 50% aa identity in 325aa overlap:

```
Orf115:    1 STGHSEQNYTLPREITRNISLGSFAYESHRKALSHHAPSQGTELPQSNGISLPYTSNSFT   60
             STG+S    Y   E++ +I +G AY+ +    +   P   +   NGI    +T
pspA:    778 STGYSRSPYEPAPEVS-SIRMGISAYKGYAPQQASDIPGTVVPVVAENGIHPTFT-----  831

Orf115:   61 PLPSSSLYIINPVNKGYLVETDPRFANYRQWLGSDYMLDSLKLDPNNLHKRLGDGYYEQR  120
             LP+SSL+ I P NKGYL+ETDP F +YR+WLGS YML +L+ DPN++HKRLGDGYYEQ+
pspA:    832 -LPNSSLFAIAPNNKGYLIETDPAFTDYRKWLGSGYMLAALQQDPNHIHKRLGDGYYEQK  890

Orf115:  121 LINEQIAELTGHRRLDGYQNDEEQFKALMDNGATAARSMNLSVGIALSAEQVAQLTSDIV  180
             L+NEQIA+LTG+RRLDGY NDEEQFKALMDNG T A+ + L+ GIALSAEQVA+LTSDIV
pspA:    891 LVNEQIAKLTGYRRLDGYTNDEEQFKALMDNGITIAKELQLTPGIALSAEQVARLTSDIV  950

Orf115:  181 WLVQKEVKLPDGGTQTVLVPQVYVRVKNGDIDGKGALLSGSNTQINVSGSLKN-SGTIAG  239
             WL + V LPDG TQTVL P+VYVR +  D++G+GALLSGS    I SG+++N  G IAG
pspA:    951 WLENETVTLPDGTTQTVLKPKVYVRARPKDMNGQGALLSGSVVDIG-SGAIENRGGLIAG 1009

Orf115:  240 RNALIINTDTLDNIGGRIHAQKSAVTATQDINNIGGMLSAEQTLLLNAGXXXXXXXXXXX  299
             R ALI+N  + N+ G +  +    A DI N G + AE  LLL A
pspA:   1010 REALILNAQNIKNLQGDLQGKNIFAAAGSDITNTGS-IGAENALLLKASNNIESRSETRS 1068

Orf115:  300 XXXXXXXXXYLDRMAGIYITGKEKG                                    324
                      + R+AGIY+TG++ G
pspA:   1069 NQNEQGSVRNIGRVAGIYLTGRQNG                                   1093
```

Homology with a Predicted ORF from *N. gonorrhoeae*
ORF115 shows 91.9% identity over a 334aa overlap with a predicted ORF (ORF115ng) from *N. gonorrhoeae*:

```
orf115.pep                              STGHSEQNYTLPREITRNISLGSFAYESHRK    31
                                        ||| ||||||||| |||:|||||||||||||
orf115ng    NEQTFGEKKVFSENGKLHNYWRARRKGHDETGHREQNYTLPEEITRDISLGSFAYESHSK    71
orf115.pep  ALSHHAPSQGTELPQSN----------GISLPYTSNSFTPLPSSSLYIINPVNKGYLVET    81
            |||:|||||||||||||          |||||||| ||||||||:||||||:||||||||
orf115ng    ALSRHAPSQGTELPQSNRDNIRTAKSNGISLPYTPNSFTPLPGSSLYIINPANKGYLVET   131
orf115.pep  DPRFANYRQWLGSDYMLDSLKLDPNNLHKRLGDGYYEQRLINEQIAELTGHRRLDGYQND   141
            |||||||||||||||| ||||||||||||||||||||||||||||||||||||||||||
orf115ng    DPRFANYRQWLGSDYMLGSLKLDPNNLHKRLGDGYYEQRLINEQIAELTGHRRLDGYQND   191
orf115.pep  EEQFKALMDNGATAARSMNLSVGIALSAEQVAQLTSDIVWLVQKEVKLPDGGTQTVVMPQ   201
            |||||||||||||||||||||||||||||| :|||||||||||||||||||||||:||
orf115ng    EEQFKALMDNGATAARSMNLSVGIALSAEQAAQLTSDIVWLVQKEVKLPDGGTQTVLMPQ   251
orf115.pep  VYVRVKNGDIDGKGALLSGSNTQINVSGSLKNSGTIAGRNALIINTDTLDNIGGRIHAQK   261
            |||||||| |||||||||||||||||||||||||||||||||||||||||||||||||
orf115ng    VYVRVKNGGIDGKGALLSGSNTQINVSGSLKNSGTIAGRNALIINTDTLDNIGGRIHAQK   311
orf115.pep  SAVTATQDINNIGGMLSAEQTLLLNAGNNINSQSTTASSQNTQGSSTYLDRMAGIYITGK   321
            ||||||||||||||:|||||||||||||||| ||:|||:|| |||||||||||||||||
orf115ng    SAVTATQDINNIGGILSAEQTLLLNAGNNINNQSTAKSSQNAQGSSTYLDRMAGIYITGK   371
orf115.pep  EKGV                                                          325
            ||||
orf115ng    EKGVLAAQAGKDINIIAGQISNQSDQGQTRLQAGRDINLDTVQTGKYQEIHFDADNHTIR   431
```

An ORF115ng nucleotide sequence <SEQ ID 513> was predicted to encode a protein having amino acid sequence <SEQ ID 514>:

```
  1 MLVQTEKDGL HNEQTFGEKK VFSENGKLHN YWRARRKGHD ETGHREQNYT
 51 LPEEITRDIS LGSFAYESHS KALSRHAPSQ GTELPQSNRD NIRTAKSNGI
101 SLPYTPNSFT PLPGSSLYII NPANKGYLVE TDPRFANYRQ WLGSDYMLGS
151 LKLDPNNLHK RLGDGYYEQR LINEQIAELT GHRRLDGYQN DEEQFKALMD
201 NGATAARSMN LSVGIALSAE QAAQLTSDIV WLVQKEVKLP DGGTQTVLMP
251 QVYVRVKNGG IDGKGALLSG SNTQINVSGS LKNSGTIAGR NALIINTDTL
301 DNIGGRIHAQ KSAVTATQDI NNIGGILSAE QTLLLNAGNN INNQSTAKSS
351 QNAQGSSTYL DRMAGIYITG KEKGVLAAQA GKDINIIAGQ ISNQSDQGQT
401 RLQAGRDINL DTVQTGKYQE IHFDADNHTI RGSTNEVGSS IQTKGDVTLL
451 SGNNLNAKAA EVGSAKGTLA VYAKNDITIS SGIHAGQVDD ASKHTGRSGG
501 GNKLVITDKA QSHHETAQSS TFEGKQVVLQ AGNDANILGS NVISDNGTRI
551 QAGNHVRIGT TQTQSQSETY HQTQKSGLMS AGIGFTIGSK TNTQENQSQS
601 NEHTGSTVGS LKGDTTIVAS KHYEQTGSNV SSPEGNNLIS TQSMDIGAAQ
651 NQLNSKTTQT YEQKGLTVAF SSPVTDLAQQ AIAVAHKAAK QFDKAKTTAL
701 MPWRLPMQVG RLFKQAKAPK K*
```

Further work revealed the following partial gonococcal DNA sequence <SEQ ID 515>:

```
  1 TTGCTTGTGC AAACAGAAAA AGACGGTTTG CATAACGAGC AAACCTTTGG
 51 CGAGAAGAAA GTCTTCAGCG AAAATGGTAA GTTGCACAAC TACTGGCGTG
101 CGCGTCGTAA AGGACATGAT GAAACAGGGC ATCGTGAACA AAATTATACT
151 TTGCCGGAGG AAATCACACG CGACATTTCA CTGGGTTCAT TTGCCTATGA
```

-continued

```
 201 ATCGCATAGC AAAGCATTAA GCCGTCATGC GCCCAGCCAA GGCACTGAGT
 251 TGCCACAAAG TAACCGGGAT AATATCCGTA CTGCGAAAAG CAACGGTATT
 301 TCGCTACCCT ATACGCCCAA TTCTTTTACC CCATTACCCG GCAGCAGCTT
 351 ATACATTATC AATCCTGCCA ATAAAGGCTA TCTTGTTGAA ACCGATCCAC
 401 GCTTTGCCAA CTACCGTCAA TGGTTGGGTA GTGACTATAT GCTGGGCAGC
 451 CTCAAACTAG ACCCAAACAA TTTACATAAA CGTTTGGGTG ATGGTTATTA
 501 CGAGCAACGT TTAATCAATG AACAAATCGC AGAGCTGACA GGGCATCGTC
 551 GTTTAGACGG TTATCAAAAC GACGAAGAAC AATTTAAAGC CTTAATGGAT
 601 AATGGCGCGA CTGCGGCACG TTCGATGAAT CTCAGCGTTG GCATTGCATT
 651 AAGTGCCGAG CAAGCAGCGC AACTGACCAG CGATATTGTT TGGTTGGTAC
 701 AAAAAGAAGT TAAACTTCCT GATGGCGGCA CACAAACCGT ATTGATGCCA
 751 CAGGTTTATG TACGCGTTAA AAATGGCGGC ATAGACGGTA AAGGTGCATT
 801 GTTGTCAGGC AGCAATACAC AAATCAATGT TTCAGGCAGC CTGAAAAACT
 851 CAGGCACGAT TGCAGGGCGC AATGCGCTTA TTATCAATAC CGATACGCTA
 901 GACAATATCG GTGGGCGTAT TCATGCGCAA AAATCAGCGG TTACGGCCAC
 951 ACAAGACATC AATAATATTG GCGGCATTCT TTCTGCCGAA CAGACATTAT
1001 TGCTCAATGC GGGTAACAAC ATCAACAACC AAAGCACGGC CAAGAGCAGT
1051 CAAAATGCAC AAGGTAGCAG CACCTACCTA GACCGAATGG CAGGTATTTA
1101 TATCACAGGC AAAGAAAAAG GTGTTTTAGC AGCGCAGGCA GGCAAAGACA
1151 TCAACATCAT TGCCGGTCAA ATCAGCAATC AATCAGATCA AGGGCAAACC
1201 CGGCTGCAGG CAGGACGCGA CATTAACCTG GATACGGTAC AAACCGGCAA
1251 ATATCAAGAA ATCCATTTTG ATGCCGATAA CCATACCATC CGAGGTTCAA
1301 CGAACGAAGT CGGCAGCAGC ATTCAAACAA AAGGCGATGT TACCCtatTG
1351 TCAGGGAATA ATCTCAATGC CAAAGCTGCC GAAGTCGGCA GCGCAAAAGG
1401 CACACTTGCC GTGTATGCTA AAAATGACAT TACTATCAGC TCAGGCATCC
1451 ATGCCGGCCA AGTTGATGAT GCGTCCAAAC ATACAGGCAG AAGCGGCGGC
1501 GGTAATAAAT TAGTCATTAC CGATAAAGCC CAAAGTCATC ACGAAACTGC
1551 TCAAAGCAGC ACCTTTGAAG GCAAGCAAGT TGTATTGCAG GCAGGAAACG
1601 ATGCCAACAT CCTTGGCAGT AATGTTATTT CCGATAATGG CACCCGGATT
1651 CAAGCAGGCA ATCATGTTCG CATTGGTACA ACCCAAACTC AAAGCCAAAG
1701 CGAAACCTAT CATCAAACCC AAAAATCAGG ATTGATGAGT GCAGGTATCG
1751 GCTTCACTAT TGGCAGCAAG ACAAACACAC AAGAAAACCA ATCCCAAAGC
1801 AACGAACATA CAGGCAGTAC CGTAGGCAGC CTGAAAGGCG ATACCACCAT
1851 TGTTGCAAGC AAACACTACG AACAAACCGG CAGCAACGTT TCCAGCCCTG
1901 AGGGCAACAA CCTTATCAGC ACGCAAAGTA TGGATATTGG CGCAGCACAA
1951 AACCAATTAA ACAGCAAAAC CACCCAAACC TACGAACAAA AAGGCTTAAC
2001 GGTGGCATTC AGTTCGCCCG TTACCGATTT GGCACAACAA GCGATTGCCG
2051 TAGCACACAA AGCAGCAAAC AAGTCGGACA AGCAAAAAC GACCGCGTTA
2101 ATGCCATGGC GGCTGCCAAT GCAGGTTGGC AGGCCTATCA AACAGGCAAA
2151 GGCGCACAAA ACTTAG
```

This corresponds to the amino acid sequence <SEQ ID 516; ORF115ng-1>:

```
  1 LLVQTEKDGL HNEQTFGEKK VFSENGKLHN YWRARRKGHD ETGHREQNYT
 51 LPEEITRDIS LGSFAYESHS KALSRHAPSQ GTELPQSNRD NIRTAKSNGI
101 SLPYTPNSFT PLPGSSLYII NPANKGYLVE TDPRFANYRQ WLGSDYMLGS
151 LKLDPNNLHK RLGDGYYEQR LINEQIAELT GHRRLDGYQN DEEQFKALMD
201 NGATAARSMN LSVGIALSAE QAAQLTSDIV WLVQKEVKLP DGGTQTVLMP
251 QVYVRVKNGG IDGKGALLSG SNTQINVSGS LKNSGTIAGR NALIINTDTL
301 DNIGGRIHAQ KSAVTATQDI NNIGGILSAE QTLLLNAGNN INNQSTAKSS
351 QNAQGSSTYL DRMAGIYITG KEKGVLAAQA GKDINIIAGQ ISNQSDQGQT
401 RLQAGRDINL DTVQTGKYQE IHFDADNHTI RGSTNEVGSS IQTKGDVTLL
451 SGNNLNAKAA EVGSAKGTLA VYAKNDITIS SGIHAGQVDD ASKHTGRSGG
501 GNKLVITDKA QSHHETAQSS TFEGKQVVLQ AGNDANILGS NVISDNGTRI
551 QAGNHVRIGT TQTQSQSETY HQTQKSGLMS AGIGFTIGSK TNTQENQSQS
601 NEHTGSTVGS LKGDTTIVAS KHYEQTGSNV SSPEGNNLIS TQSMDIGAAQ
651 NQLNSKTTQT YEQKGLTVAF SSPVTDLAQQ AIAVAHKAAN KSDKAKTTAL
701 MPWRLPMQVG RPIKQAKAHK T*
```

This gonococcal protein (ORF115ng-1) shows 91.9% identity with ORF 115 over 334aa:

```
                        20        30        40        50        60        70
      orf115ng-1.p NEQTFGEKKVGSENGKSHNYWRARRKGHDETGHREQNYTLPEEITRDISLGSFAYESHSK
                      |||||||||:||||  ||||||||||||:||||||||||||:||||||||||||| |
      orf115                      STGHSEQNYTLPREITRNISLGSFAYESHRK
                                                      10        20        30
                        80        90       100       110       120       130
      orf115ng-1.p ALSRHAPSQGTELPQSNRDNIRTAKSNGISLPYTPNSFTPLPGSSLYIINPANKGYLVET
                   |||:|||||||||||||          ||||||| ||||||||:|||||||:|||||||
      orf115      ALSHHAPSQGTELPQSN----------GISLPYTSNSFTPLPSSSLYIINPVNKGYLVET
                        40                  50        60        70        80
                       140       150       160       170       180       190
      orf115ng-1.p DPRFANYRQWLGSDYMLGSLKLDPNNLHKRLGDGYYEQRLINEQIAELTGHRRLDGYQND
                   |||||||||||||||||:|||||||||||||||||||||||||||||||||||||||||
      orf115      DPRFANYRQWLGSDYMLDSLKLDPNNLHKRLGDGYYEQRLINEQIAELTGHRRLDGYQND
                        90       100       110       120       130       140
                       200       210       220       230       240       250
      orf115ng-1.p EEQFKALMDNGATAARSMNLSVGIALSAEQAAQLTSDIVWLVQKEVKLPDGGTQTVLMPQ
                   |||||||||||||||||||||||||||||:||||||||||||||||||||||||||:||
      orf115      EEQFKALMDNGATAARSMNLSVGIALSAEQVAQLTSDIVWLVQKEVKLPDGGTQTVLVPQ
                       150       160       170       180       190       200
                       260       270       280       290       300       310
      orf115ng-1.p VYVRVKNGGIDGKGALLSGSNTQINVSGSLKNSGTIAGRNALIINTDTLDNIGGRIHAQK
                   ||||||||:||||||||||||||||||||||||||||||||||||||||||||||||||
      orf115      VYVRVKNGDIDGKGALLSGSNTQINVSGSLKNSGTIAGRNALIINTDTLDNIGGRIHAQK
                       210       220       230       240       250       260
                       320       330       340       350       360       370
      orf115ng-1.p SAVTATQDINNIGGILSAEQTLLLNAGNNINNQSTAKSSQNAQGSSTYLDRMAGIYITGK
                   |||||||||||||||:||||||||||||||:|:|| :||:|||||||||||||||||||
      orf115      SAVTATQDINNIGGMLSAEQTLLLNAGNNINSQSTTASSQNTQGSSTYLDRMAGIYITGK
                       270       280       290       300       310       320
                       380       390       400       410       420       430
      orf115ng-1.p EKGVLAAQAGKDINIIAGQISNQSDQGQTRLQAGRDINLDTVQTGKYQEIHFDADNHTIR
                   ||||
      orf115      EKGV
```

In addition, it snows homology with a secreted *N. meningitidis* protein in the database:

```
gi|2623258 (AF030941) putative secreted protein [Neisseria meningitidis]
Length = 2273
  Score = 604 bits (1541), Expect = e-172
  Identities = 325/678 (47%), Positives = 449/678 (65%),
  Gaps = 22/678 (3%)
Query:     1 LLVQTEKDGLHNEQTFGEKKVFSENGKLHNYWRARRKGHDETGHREQNYTLPEEITRDIS   60
             L+V T +  L N++T G K + ++ G LH Y R  +KG D TG+    Y    E++  I
Sbjct:   739 LIVGTPESALDNDETLGTKTI-TDKGDLHRYHRHHKKGRDSTGYSRSPYEPAPEVS-SIR  796

Query:    61 LGSFAYESHSKALSRHAPSQGTELPQSNRDNIRTAKSNGISLPYTPNSFTPLPGSSLYII  120
             +G  AY+ +       AP Q +++P +    +     NGI   +T      LP SSL+ I
Sbjct:   797 MGISAYKGY-------APQQASDIPGTV---VPVVAENGIHPTFT------LPNSSLFAI  840

Query:   121 NPANKGYLVETDPRFANYRQWLGSDYMLGSLKLDPNNLHKRLGDGYYEQRLINEQIAELT  180
              P NKGYL+ETDP F +YR+WLGS YML +L+ DPN++HKRLGDGYYEQ+L+NEQIA+LT
Sbjct:   841 APNNKGYLIETDPAFTDYRKWLGSGYMLAALQQDPNHIHKRLGDGYYEQKLVNEQIAKLT  900

Query:   181 GHRRLDGYQNDEEQFKALMDNGATAARSMNLSVGIALSAEQAAQLTSDIVWLVQKEVKLP  240
             G+RRLDGY NDEEQFKALMDNG T A+ + L+ GIALSAEQ A+LTSDIVWL  + V LP
Sbjct:   901 GYRRLDGYTNDEEQFKALMDNGITIAKELQLTPGIALSAEQVARLTSDIVWLENETVTLP  960

Query:   241 DGGTQTVLMPQVYVRVKNGGIDGKGALLSGSNTQINVSGSLKN-SGTIAGRNALIINTDT  299
             DG TQTVL P+VYVR +   ++G+GALLSGS   I  SG+++N  G IAGR ALI+N
Sbjct:   961 DGTTQTVLKPKVYVRARPKDMNGQGALLSGSVVDIG-SGAIENRGGLIAGREALILNAQN 1019

Query:   300 LDNIGGRIHAQKSAVTATQDINNIGGILSAEQTLLLNAGNNINNQSTAKSSQNAQGSSTY  359
             + N+ G +  +     A  DI N G I  AE  LLL A NNI ++S  +S+QN QGS
Sbjct:  1020 IKNLQGDLQGKNIFAAAGSDITNTGSI-GAENALLLKASNNIESRSETRSNQNEQGSVRN 1078

Query:   360 LDRMAGIYITGKEKGVLAAQAGKDINIIAGQISNQSDQGQTRLQAGRDINLDTVQTGKYQ  419
             + R+AGIY+TG++ G +   AG +I + A +++NQS+ GQT L AG DI  DT    + Q
Sbjct:  1079 IGRVAGIYLTGRQNGSVLLDAGNNIVLTASELTNQSEDGQTVLNAGGDIRSDTTGISRNQ 1138

Query:   420 EIHFDADNHTIRGSTNEVGSSIQTKGDVTLLSGNNLNAKAAEVGSAKGTLAVYAKNDITI  479
                FD+DN+ IR   NEVGS+I+T+G+++L +  ++  +AAEVGS +G L + A  DI +
Sbjct:  1139 NTIFDSDNYVIRKEQNEVGSTIRTRGNLSLNAKGDIRIRAAEVGSEQGRLKLAAGRDIKV 1198

Query:   480 SSGIHAGQVDDASKHTGRSGGGNKLVITDKAQSHHETAQSSTFEGKQVVLQAGNDANILG  539
              +G     + +DA K+TGRSGGG K  +T   ++ +  A S T +GK+++L +G D  + G
Sbjct:  1199 EAGKAHTETEDALKYTGRSGGGIKQKMTRHLKNQNGQAVSGTLDGKEIILVSGRDITVTG 1258

Query:   540 SNVISDNGTRIQAGNHVRIGTTQTQSQSETYHQTQKSGLM-SAGIGFTIGSKTNTQENQS  598
             SN+I+DN T + A N++ +   +T+S+S   ++ +KSGLM S GIGFT GSK +TQ N+S
Sbjct:  1259 SNIIADNHTILSAKNNIVLKAAETRSRSAEMNKKEKSGLMGSGGIGFTAGSKKDTQTNRS 1318

Query:   599 QSNEHTGSTVGSLKGDTTIVASKHYEQTGSNVSSPEGNNLISTQSMDIGAAQNQLNSKTT  658
             ++  HT S VGSL G+T I A KHY QTGS +SSP+G+  IS+  + I AAQN+ + ++
Sbjct:  1319 ETVSHTESVVGSLNGNTLISAGKHYTQTGSTISSPQGDVGISSGKISIDAAQNRYSQESK 1378

Query:   659 QTYEQKGLTVAFSSPVTD                                           676
             Q YEQKG+TVA S PV +
Sbjct:  1379 QVYEQKGVTVAISVPVVN                                          1396
```

Based on this analysis, it is predicted that the proteins from *N. meningitidis* and *N. gonorrhoeae*, and their epitopes, could be useful antigens for vaccines or diagnostics, or for raising antibodies.

Example 62

The following partial DNA sequence was identified in *N. meningitidis* <SEQ ID 517>:

```
  1 ..TCAGGGAATA ACCTCAATGC CAAAGCTGCC GAAGTCAGCA GCGCAAACGG

51   TACACTCGCT GTGTCTGCCA ATAATGACAT CAACATCAGC GCAGGCATCA

101   ACACGACCCA TGTTGATGAT GCGTCCAAAC ACACAGGCAG AAGCGGTGGT

151   GGCAATAAAT TAGTCATTAC CGATAAAGCC CAAAGTCATC ACGAAACCGC
```

```
-continued
201    CCAAAGCAGC ACCTTTGAAG GCAAGCAAGT TGTATTGCAG GCAGGAAACG
251    ATGCCAACAT CCTTGGCAGC AATGTTATTT CCGATAATGG CACCCAGATT
301    CAAGCAGGCA ATCATGTTCG CATTGGTACA ACCCAAACTC AAAGCCAAAG
351    CGAAACCTAT CATCAAACCC AGAAATCAGG ATTGATGAGT GCAGGTATCG
401    GCTTCACTAT TGGCAGCAAG ACAAACACAC AAGAAAACCA ATCCCAAAGC
451    AACGAACATA CAGGCAGTAC CGTAGGCAGC TTGAAAGGCG ATACCACCAT
501    TGTTGCAGGC AAACACTACG AACAAATCGG CAGTACCGTT TCCAGCCCGG
551    AAGGCAACAA TACCATCTAT GCCCAAAGCA TAGACATTCA AGCGGCACAC
601    AACAAATTAA ACAGTAATAC CACCCAAACC TATGAACAAA AAGG.CTAAC
651    GGTGGCATTC AGTTCGCCCG TTACCGATTT GGCACAACAA ...
```

This corresponds to the amino acid sequence <SEQ ID 518; ORF117>:

```
  1    ..SGNNLNAKAA EVSSANGTLA VSANNDINIS AGINTTHVDD ASKHTGRSGG

51    GNKLVITDKA QSHHETAQSS TFEGKQVVLQ AGNDANILGS NVISDNGTQI

101    QAGNHVRIGT TQTQSQSETY HQTQKSGLMS AGIGFTIGSK TNTQENQSQS

151    NEHTGSTVGS LKGDTTIVAG KHYEQIGSTV SSPEGNNTIY AQSIDIQAAH

201    NKLNSNTTQT YEQKXLTVAF SSPVTDLAQQ ...
```

Computer analysis of this amino acid sequence gave the following results:

Homology with the pspA Putative Secreted Protein of *N. meningitidis* (Accession Number AF030941)

ORF117 and pspA protein show 45% aa identity in 224aa overlap:

```
Orf117:       4 NLNAKAAEVSSANGTLAVSANNDINISAGINTTHVDDASKHTGRSGGGNKLVITDKAQSH    63
                ++  +AAEV S  G L ++A DI + AG   T  +DA K+TGRSGGG K  +T   ++
pspA:      1173 DIRIRAAEVGSEQGRLKLAAGRDIKVEAGKAHTETEDALKYTGRSGGGIKQKMTRHLKNQ  1232

Orf117:      64 HETAQSSTFEGKQVVLQAGNDANILGSNVISDNGTQIQAGNHVRIGTTQTQSQSETYHQT   123
                +  A S T +GK+++L +G D   + GSN+I+DN T + A N++ +    +T+S+S   ++
pspA:      1233 NGQAVSGTLDGKEIILVSGRDITVTGSNIIADNHTILSAKNNIVLKAAETRSRSAEMNKK  1292

Orf117:     124 QKSGLM-SAGIGFTIGSKTNTQENQSQSNEHTGSTVGSLKGDTTIVAGKHYEQIGSTVSS   182
                +KSGLM S GIGFT GSK +TQ N+S++  HT S VGSL G+T I  AGKHY Q GST+SS
pspA:      1293 EKSGLMGSGGIGFTAGSKKDTQTNRSETVSHTESVVGSLNGNTLISAGKHYTQTGSTISS  1352

Orf117:     183 PEGNNTIYAQSIDIQAAHNKLNSNTTQTYEQKXLTVAFSSPVTD                  226
                P+G+  I +  I I AA N+ +  + Q YEQK +TVA S PV +
pspA:      1353 PQGDVGISSGKISIDAAQNRYSQESKQVYEQKGVTVAISVPVVN                 1396
```

Homology with a Predicted ORF from *N. gonorrhoeae*

ORF117 shows 90% identity over a 230aa overlap with a predicted ORF (ORF117ng) from *N. gonorrhoeae*:

```
orf117.pep                           SGNNLNAKAAEVSSANGTLAVSANNDINIS    30
                                     |||||||||||:|:|||||  :|||:||
orf117ng    IHFDADNHTIRGSTNEVGSSIQTKGDVTLLSGNNLNAKAAEVGSAKGTLAVYAKNDITIS   480
orf117.pep  AGINTTHVDDASKHTGRSGGGNKLVITDKAQSHHETAQSSTFEGKQVVLQAGNDANILGS    90
            :||::  ||||||||||||||||||||||||||||||||||||||||||||||||||||
orf117ng    SGIHAGQVDDASKHTGRSGGGNKLVITDKAQSHHETAQSSTFEGKQVVLQAGNDANILGS   540
orf117.pep  NVISDNGTQIQAGNHVRIGTTQTQSQSETYHQTQKSGLMSAGIGFTIGSKTNTQENQSQS   150
            ||||||||:|||||||||||||||||||||||||||||||||||||||||||||||||||
orf117ng    NVISDNGTRIQAGNHVRIGTTQTQSQSETYHQTQKSGLMSAGIGFTIGSKTNTQENQSQS   600
orf117.pep  NEHTGSTVGSLKGDTTIVAGKHYEQIGSTVSSPEGNNTIYAQSIDIQAAHNKLNSNTTQT   210
            |||||||||||||||||||:|||||:||:||||||||:|:||  :||:|:|||:||||||
orf117ng    NEHTGSTVGSLKGDTTIVASKHYEQTGSNVSSPEGNNLISTQSMDIGAAQNQLNSKTTQT   660
orf117.pep  YEQKXLTVAFSSPVTDLAQQ                                           230
            ||||  ||||||||||||||
orf117ng    YEQKGLTVAFSSPVTDLAQQAIAVAHKAAKQFDKAKTTALMPWRLPMQVGRLFKQAKAPK   720
```

An ORF117ng nucleotide sequence <SEQ ID 519> was predicted to encode a protein having amino acid sequence <SEQ ID 520>:

```
  1  ..LLVQTEKDGL HNEQTFGEKK VFSENGKLHN YWRARRKGHD ETGHREQNYT
 51    LPEEITRDIS LGSFAYESHS KALSRHAPSQ GTELPQSNRD NIRTAKSNGI
101    SLPYTPNSFT PLPGSSLYII NPANKGYLVE TDPRFANYRQ WLGSDYMLGS
151    LKLDPNNLHK RLGDGYYEQR LINEQIAELT GHRRLDGYQN DEEQFKALMD
201    NGATAARSMN LSVGIALSAE QAAQLTSDIV WLVQKEVKLP DGGTQTVLMP
251    QVYVRVKNGG IDGKGALLSG SNTQINVSGS LKNSGTIAGR NALIINTDTL
301    DNIGGRIHAQ KSAVTATQDI NNIGGILSAE QTLLLNAGNN INNQSTAKSS
351    QNAQGSSTYL DRMAGIYITG KEKGVLAAQA GKDINIIAGQ ISNQSDQGQT
401    RLQAGRDINL DTVQTGKYQE IHFDADNHTI RGSTNEVGSS IQTKGDVTLL
451    SGNNLNAKAA EVGSAKGTLA VYAKNDITIS SGIHAGQVDD ASKHTGRSGG
501    GNKLVITDKA QSHHETAQSS TFEGKQVVLQ AGNDANILGS NVISDNGTRI
551    QAGNHVRIGT TQTQSQSETY HQTQKSGLMS AGIGFTIGSK TNTQENQSQS
601    NEHTGSTVGS LKGDTTIVAS KHYEQTGSNV SSPEGNNLIS TQSMDIGAAQ
651    NQLNSKTTQT YEQKGLTVAF SSPVTDLAQQ AIAVAHKAAK QFDKAKTTAL
701    MPWRLPMQVG RLFKQAKAPK K*
```

Further work revealed the following gonococcal partial DNA sequence <SEQ ID 521>:

```
  1 TTGCTTGTGC AAACAGAAAA AGACGGTTTG CATAACGAGC AAACCTTTGG
 51 CGAGAAGAAA GTCTTCAGCG AAAATGGTAA GTTGCACAAC TACTGGCGTG
101 CGCGTCGTAA AGGACATGAT GAAACAGGGC ATCGTGAACA AAATTATACT
151 TTGCCGGAGG AAATCACACG CGACATTTCA CTGGGTTCAT TTGCCTATGA
201 ATCGCATAGC AAAGCATTAA GCCGTCATGC GCCCAGCCAA GGCACTGAGT
251 TGCCACAAAG TAACCGGGAT AATATCCGTA CTGCGAAAAG CAACGGTATT
301 TCGCTACCCT ATACGCCCAA TTCTTTTACC CCATTACCCG GCAGCAGCTT
351 ATACATTATC AATCCTGCCA ATAAAGGCTA TCTTGTTGAA ACCGATCCAC
401 GCTTTGCCAA CTACCGTCAA TGGTTGGGTA GTGACTATAT GCTGGGCAGC
```

```
-continued
 451 CTCAAACTAG ACCCAAACAA TTTACATAAA CGTTTGGGTG ATGGTTATTA

501 CGAGCAACGT TTAATCAATG AACAAATCGC AGAGCTGACA GGGCATCGTC

551 GTTTAGACGG TTATCAAAAC GACGAAGAAC AATTTAAAGC CTTAATGGAT

601 AATGGCGCGA CTGCGGCACG TTCGATGAAT CTCAGCGTTG GCATTGCATT

651 AAGTGCCGAG CAAGCAGCGC AACTGACCAG CGATATTGTT TGGTTGGTAC

701 AAAAAGAAGT TAAACTTCCT GATGGCGGCA CACAAACCGT ATTGATGCCA

751 CAGGTTTATG TACGCGTTAA AAATGGCGGC ATAGACGGTA AAGGTGCATT

801 GTTGTCAGGC AGCAATACAC AAATCAATGT TTCAGGCAGC CTGAAAAACT

851 CAGGCACGAT TGCAGGGCGC AATGCGCTTA TTATCAATAC CGATACGCTA

901 GACAATATCG GTGGGCGTAT TCATGCGCAA AAATCAGCGG TTACGGCCAC

951 ACAAGACATC AATAATATTG GCGGCATTCT TTCTGCCGAA CAGACATTAT

1001 TGCTCAATGC GGGTAACAAC ATCAACAACC AAAGCACGGC CAAGAGCAGT

1051 CAAAATGCAC AAGGTAGCAG CACCTACCTA GACCGAATGG CAGGTATTTA

1101 TATCACAGGC AAAGAAAAAG GTGTTTTAGC AGCGCAGGCA GGCAAAGACA

1151 TCAACATCAT TGCCGGTCAA ATCAGCAATC AATCAGATCA AGGGCAAACC

1201 CGGCTGCAGG CAGGACGCGA CATTAACCTG GATACGGTAC AAACCGGCAA

1251 ATATCAAGAA ATCCATTTTG ATGCCGATAA CCATACCATC CGAGGTTCAA

1301 CGAACGAAGT CGGCAGCAGC ATTCAAACAA AAGGCGATGT TACCCtatTG

1351 TCAGGGAATA ATCTCAATGC CAAAGCTGCC GAAGTCGGCA GCGCAAAAGG

1401 CACACTTGCC GTGTATGCTA AAAATGACAT TACTATCAGC TCAGGCATCC

1451 ATGCCGGCCA AGTTGATGAT GCGTCCAAAC ATACAGGCAG AAGCGGCGGC

1501 GGTAATAAAT TAGTCATTAC CGATAAAGCC CAAAGTCATC ACGAAACTGC

1551 TCAAAGCAGC ACCTTTGAAG GCAAGCAAGT TGTATTGCAG GCAGGAAACG

1601 ATGCCAACAT CCTTGGCAGT AATGTTATTT CCGATAATGG CACCCGGATT

1651 CAAGCAGGCA ATCATGTTCG CATTGGTACA ACCCAAACTC AAAGCCAAAG

1701 CGAAACCTAT CATCAAACCC AAAAATCAGG ATTGATGAGT GCAGGTATCG

1751 GCTTCACTAT TGGCAGCAAG ACAAACACAC AAGAAAACCA ATCCCAAAGC

1801 AACGAACATA CAGGCAGTAC CGTAGGCAGC CTGAAAGGCG ATACCACCAT

1851 TGTTGCAAGC AAACACTACG AACAAACCGG CAGCAACGTT TCCAGCCCTG

1901 AGGGCAACAA CCTTATCAGC ACGCAAAGTA TGGATATTGG CGCAGCACAA

1951 AACCAATTAA ACAGCAAAAC CACCCAAACC TACGAACAAA AAGGCTTAAC

2001 GGTGGCATTC AGTTCGCCCG TTACCGATTT GGCACAACAA GCGATTGCCG

2051 TAGCACACAA AGCAGCAAAC AAGTCGGACA AGCAAAAAC GACCGCGTTA

2101 ATGCCATGGC GGCTGCCAAT GCAGGTTGGC AGGCCTATCA AACAGGCAAA

2151 GGCGCACAAA ACTTAG
```

This corresponds to the amino acid sequence <SEQ ID 522; ORF117ng-1>:

```
  1 LLVQTEKDGL HNEQTFGEKK VFSENGKLHN YWRARRKGHD ETGHREQNYT

51 LPEEITRDIS LGSFAYESHS KALSRHAPSQ GTELPQSNRD NIRTAKSNGI

101 SLPYTPNSFT PLPGSSLYII NPANKGYLVE TDPRFANYRQ WLGSDYMLGS

151 LKLDPNNLHK RLGDGYYEQR LINEQIAELT GHRRLDGYQN DEEQFKALMD

201 NGATAARSMN LSVGIALSAE QAAQLTSDIV WLVQKEVKLP DGGTQTVLMP

251 QVYVRVKNGG IDGKGALLSG SNTQINVSGS LKNSGTIAGR NALIINTDTL

301 DNIGGRIHAQ KSAVTATQDI NNIGGILSAE QTLLLNAGNN INNQSTAKSS

351 QNAQGSSTYL DRMAGIYITG KEKGVLAAQA GKDINIIAGQ ISNQSDQGQT

401 RLQAGRDINL DTVQTGKYQE IHFDADNHTI RGSTNEVGSS IQTKGDVTLL

451 SGNNLNAKAA EVGSAKGTLA VYAKNDITIS SGIHAGQVDD ASKHTGRSGG

501 GNKLVITDKA QSHHETAQSS TFEGKQVVLQ AGNDANILGS NVISDNGTRI

551 QAGNHVRIGT TQTQSQSETY HQTQKSGLMS AGIGFTIGSK TNTQENQSQS

601 NEHTGSTVGS LKGDTTIVAS KHYEQTGSNV SSPEGNNLIS TQSMDIGAAQ

651 NQLNSKTTQT YEQKGLTVAF SSPVTDLAQQ AIAVAHKAAN KSDKAKTTAL

701 MPWRLPMQVG RPIKQAKAHK T*
```

ORF117ng-1 shows the same 90% identity over a 230aa overlap with ORF117. In addition, it shows homology with a secreted *N. meningitidis* protein in the database:

```
gi|2623258 (AF030941) putative secreted protein [Neisseria meningitidis]
Length = 2273
  Score = 604 bits (1541), Expect = e-172
  Identities = 325/678 (47%), Positives = 449/678 (65%), Gaps = 22/678 (3%)

Query:     1 LLVQTEKDGLHNEQTFGEKKVFSENGKLHNYWRARRKGHDETGHREQNYTLPEEITRDIS    60
             L+V T +  L N++T G K + ++ G LH Y R  +KG D TG+     Y   E++   I
Sbjct:   739 LIVGTPESALDNDETLGTKTI-TDKGDLHRYHRHHKKGRDSTGYSRSPYEPAPEVS-SIR   796

Query:    61 LGSFAYESHSKALSRHAPSQGTELPQSNRDNIRTAKSNGISLPYTPNSFTPLPGSSLYII   120
             +G  AY+ +          AP Q +++P +   +    NGI   +T       LP SSL+ I
Sbjct:   797 MGISAYKGY-------APQQASDIPGTV---VPVVAENGIHPTFT------LPNSSLFAI   840

Query:   121 NPANKGYLVETDPRFANYRQWLGSDYMLGSLKLDPNNLHKRLGDGYYEQRLINEQIAELT   180
              P NKGYL+ETDP F +YR+WLGS YML +L+ DPN++HKRLGDGYYEQ+L+NEQIA+LT
Sbjct:   841 APNKGYLIETDPAFTDYRKWLGSGYMLAALQQDPNHIHKRLGDGYYEQKLVNEQIAKLT   900

Query:   181 GHRRLDGYQNDEEQFKALMDNGATAARSMNLSVGIALSAEQAAQLTSDIVWLVQKEVKLP   240
             G+RRLDGY NDEEQFKALMDNG T A+ + L+ GIALSAEQ A+LTSDIVWL   + V LP
Sbjct:   901 GYRRLDGYTNDEEQFKALMDNGITIAKELQLTPGIALSAEQVARLTSDIVWLENETVTLP   960

Query:   241 DGGTQTVLMPQVYVRVKNGGIDGKGALLSGSNTQINVSGSLKN-SGTIAGRNALIINTDT   299
             DG TQTVL P+VYVR +   ++G+GALLSGS   I   SG+++N  G  IAGR ALI+N
Sbjct:   961 DGTTQTVLKPKVYVRARPKDMNGQGALLSGSVVDIG-SGAIENRGGLIAGREALILNAQN  1019

Query:   300 LDNIGGRIHAQKSAVTATQDINNIGGILSAEQTLLLNAGNNINNQSTAKSSQNAQGSSTY   359
             + N+ G + +      A  DI N G I  AE   LLL A NNI ++S   +S+QN QGS
Sbjct:  1020 IKNLQGDLQGKNIFAAAGSDITNTGSI-GAENALLLKASNNIESRSETRSNQNEQGSVRN  1078

Query:   360 LDRMAGIYITGKEKGVLAAQAGKDINIIAGQISNQSDQGQTRLQAGRDINLDTVQTGKYQ   419
             + R+AGIY+TG++ G +    AG +I + A +++NQS+ GQT L AG DI    DT    + Q
Sbjct:  1079 IGRVAGIYLTGRQNGSVLLDAGNNIVLTASELTNQSEDGQTVLNAGGDIRSDTTGISRNQ  1138

Query:   420 EIHFDADNHTIRGSTNEVGSSIQTKGDVTLLSGNNLNAKAAEVGSAKGTLAVYAKNDITI   479
                FD+DN+  IR    NEVGS+I+T+G+++L  +   ++ +AAEVGS +G L  + A   DI +
Sbjct:  1139 NTIFDSDNYVIRKEQNEVGSTIRTRGNLSLNAKGDIRIRAAEVGSEQGRLKLAAGRDIKV  1198

Query:   480 SSGIHAGQVDDASKHTGRSGGGNKLVITDKAQSHHETAQSSTFEGKQVVLQAGNDANILG   539
             +G       + +DA K+TGRSGGG K +T  ++ +   A S T +GK+++L +G D    + G
```

```
                              -continued
Sbjct:  1199 EAGKAHTETEDALKYTGRSGGGIKQKMTRHLKNQNGQAVSGTLDGKEIILVSGRDITVTG 1258

Query:   540 SNVISDNGTRIQAGNHVRIGTTQTQSQSETYHQTQKSGLM-SAGIGFTIGSKTNTQENQS  598
             SN+I+DN T + A N++ +    +T+S+S    ++ +KSGLM S GIGFT GSK +TQ N+S
Sbjct:  1259 SNIIADNHTILSAKNNIVLKAAETRSRSAEMNKKEKSGLMGSGGIGFTAGSKKDTQTNRS 1318

Query:   599 QSNEHTGSTVGSLKGDTTIVASKHYEQTGSNVSSPEGNNLISTQSMDIGAAQNQLNSKTT  658
             ++   HT S VGSL G+T I A KHY QTGS +SSP+G+   IS+   + I AAQN+ +  ++
Sbjct:  1319 ETVSHTESVVGSLNGNTLISAGKHYTQTGSTISSPQGDVGISSGKISIDAAQNRYSQESK 1378

Query:   659 QTYEQKGLTVAFSSPVTD                                            676
             Q YEQKG+TVA S PV +
Sbjct:  1379 QVYEQKGVTVAISVPVVN                                           1396
```

Based on this analysis, it is predicted that the proteins from *N. meningitidis* and *N. gonorrhoeae*, and their epitopes, could be useful antigens for vaccines or diagnostics, or for raising antibodies.

Example 63

The following partial DNA sequence was identified in *N. meningitidis* <SEQ ID 523>:

```
  1 ATGATTTACA TCGTACTGTT TCTAGCTGTC GTCCTCGCCG TTGTCGCCTA

51 CAACATGTAT CAGGAAAACC AATACCGCAA AAAAGTGCGC GACCAGTTCG

101 GACACTCCGA CAAAGATGCC CTGCTCAACA GCAwAACCAG CCATGTCCGC

151 GACGGCAAAC CGTCCGGCGG GTCAGTCATG ATGCCGAAAC CCCAACCGGC

201 GGTCAAAAAA ACGGCAAAAC CCCAAGACCC CGyCATGCGC AACCTGCAAG

251 AACAGGATGC CGTCTACATC GCCAAGCAGA AACAGGCAAA AGCCTCCCCG

301 TTCAAAACCG AAATCGAAAC CGCCTTGGAA GAAAGCGGCA TTATCGGCAA

351 CTCCGCCCAC ACCGTTTCCG AACCCCAAAC CGGACATTCC GCAACGAAAC

401 CTGCCGACGC GTCGGCAAAA CCTGCACCCG TTCCGCAAAC ACCTGCAAAA

451 CCGCTGATTA CGCTCAAAGA ACTGTCAAAA GTCGAATTAT CCTGGTTTGA

501 CGTGCGCATC GACTTCATCT CCTAT...
```

This corresponds to the amino acid sequence <SEQ ID 524; ORF119>:

```
  1 MIYIVLFLAV VLAVVAYNMY QENQYRKKVR DQFGHSDKDA LLNSXTSHVR

51 DGKPSGGSVM MPKPQPAVKK TAKPQDPXMR NLQEQDAVYI AKQKQAKASP

101 FKTEIETALE ESGIIGNSAH TVSEPQTGHS ATKPADASAK PAPVPQTPAK

151 PLITLKELSK VELSWFDVRI DFISY...
```

Further work revealed the complete nucleotide sequence <SEQ ID 525>:

```
  1 ATGATTTACA TCGTACTGTT TCTAGCTGTC GTCCTCGCCG TTGTCGCCTA

51 CAACATGTAT CAGGAAAACC AATACCGCAA AAAAGTGCGC GACCAGTTCG

101 GACACTCCGA CAAAGATGCC CTGCTCAACA GCAAAACCAG CCATGTCCGC

151 GACGGCAAAC CGTCCGGCGG GTCAGTCATG ATGCCGAAAC CCCAACCGGC
```

```
                           -continued
 201 GGTCAAAAAA ACGGCAAAAC CCCAAGACCC CGCCATGCGC AACCTGCAAG

251 AACAGGATGC CGTCTACATC GCCAAGCAGA AACAGGCAAA AGCCTCCCCG

301 TTCAAAACCG AAATCGAAAC CGCCTTGGAA GAAAGCGGCA TTATCGGCAA

351 CTCCGCCCAC ACCGTTTCCG AACCCCAAAC CGGACATTCC GCACCGAAAC

401 CTGCCGACGC GCCGGCAAAA CCTGCACCCG TTCCGCAAAC ACCTGCAAAA

451 CCGCTGATTA CGCTCAAAGA ACTGTCAAAA GTCGAATTAC CCTGGTTTGA

501 CGTGCGCTTC GACTTCATCT CCTATATCGC GCTGACCGAA GCCAAAGAAC

551 TGCACGCACT GCCGCGCCTT TCCAACCGCT GCCGCTACCA GATTGTCGGC

601 TGCACCATGG ACGACCATTT CCAGATTGCC GAACCCATCC CGGGCATCCG

651 CTATCAGGCA TTTATCGTGG GTATTCAGGC AGTCAGCCGC AACGGACTTG

701 CCTCGCAGGA AGAACTCTCC GCATTCAACC GCCAGGTGGA CGCATTCGCA

751 CAAAGCATGG GCGGTCAGAC GCTGCACACC GACCTTGCCG CCTTTATCGA

801 AGTGGCTTCC GCACTGGACG CATTCTGCGC GCGCGTCGAC CAGACCATCG

851 CCATCCATTT GGTTTCCCCG ACCAGCATCA GCGGCGTAGA ACTGCGTTCC

901 GCCGTAACGG GCGTGGGTTT CGTTTTGGAA GACGACGGCG CGTTCCACTA

951 TACCGACACG TCGGGCTCGA CCATGTTCTC CATCTGCTCG CTCAACAACG

1001 AGCCGTTTAC CAACGCCCTT TTGGACAACC AGTCCTACAA AGGCTTCAGT

1051 ATGCTGCTCG ACATCCCGCA CTCTCCGGCA GGCGAAAAAA CCTTCGACGA

1101 TTTGTTTATG GATTTGGCGG TACGCCTGTC CGGCCAGTTG AACCTGAATC

1151 TGGTCAACGA CAAAATGGAA GAAGTTTCGA CCCAATGGCT CAAAGACGTG

1201 CGCACTTATG TATTGGCGCG TCAGTCCGAG ATGCTCAAAG TCGGTATCGA

1251 ACCGGGCGGC AAAACCGCAT TGCGCCTGTT CTCCTAA
```

This corresponds to the amino acid sequence <SEQ ID 526; ORF119-1>:

```
  1 MIYIVLFLAV VLAVVAYNMY QENQYRKKVR DQFGHSDKDA LLNSKTSHVR

51 DGKPSGGSVM MPKPQPAVKK TAKPQDPAMR NLQEQDAVYI AKQKQAKASP

101 FKTEIETALE ESGIIGNSAH TVSEPQTGHS APKPADAPAK PAPVPQTPAK

151 PLITLKELSK VELPWFDVRF DFISYIALTE AKELHALPRL SNRCRYQIVG

201 CTMDDHFQIA EPIPGIRYQA FIVGIQAVSR NGLASQEELS AFNRQVDAFA

251 QSMGGQTLHT DLAAFIEVAS ALDAFCARVD QTIAIHLVSP TSISGVELRS

301 AVTGVGFVLE DDGAFHYTDT SGSTMFSICS LNNEPFTNAL LDNQSYKGFS

351 MLLDIPHSPA GEKTFDDLFM DLAVRLSGQL NLNLVNDKME EVSTQWLKDV

401 RTYVLARQSE MLKVGIEPGG KTALRLFS*
```

Computer analysis of this amino acid sequence gave the following results:

Homology with a Predicted ORF from *N. meningitidis* (Strain A)

ORF119 shows 93.7% identity over a 175aa overlap with an ORF (ORF119a) from strain A of *N. meningitidis*:

```
                  10        20        30        40        50        60
orf119.pep  MIYIVLFLAVVLAVVAYNMYQENQYRKKVRDQFGHSDKDALLNSXTSHVRDGKPSGGSVM
            ||||||||||:|||||||||||||||||||||||||||||||||| |||||||||| ||
orf119a     MIYIVLFLAAVLAVVAYNMYQENQYRKKVRDQFGHSDKDALLNSKTSHVRDGKPSGGPVM
                  10        20        30        40        50        60
                  70        80        90       100       110       120
orf119.pep  MPKPQPAVKKTAKPQDPXMRNLQEQDAVYIAKQKQAKASPFKTEIETALEESGIIGNSAH
            ||||||||||||| ||| ||||||||||||||||||||||||||||||||||||||||||
orf119a     MPKPQPAVKKTAKSQDPAMRNLQEQDAVYIAKQKQAKASPFKTEIETALEESGIIGNSAH
                  70        80        90       100       110       120
                 130       140       150       160       170
orf119.pep  TVSEPQTGHSATKPADASAKPAPVPQTPAKPLITLKELSKVELSWFDVRIDFISY
            || ||||||||| |||| |||| |||||||||||||||||||| |||||:||||
orf119a     TVPEPQTGHSAPKPADAPAKPVPVPQTPAKPLITLKELSKVELPWFDVRPDFISYIALTE
                 130       140       150       160       170       180
orf119a     AKELHALPRLSNRCRYQIVGCTMDDHFQIAEPIPGIRYQAFIVGIQAVSRNGLASQEELS
                 190       200       210       220       230       240
```

The complete length ORF119a nucleotide sequence <SEQ ID 527> is:

```
   1 ATGATTTACA TCGTACTGTT CCTCGCCGCC GTCCTCGCCG TTGTCGCCTA
  51 CAATATGTAT CAGGAAAACC AATACCGCAA AAAAGTGCGC GACCAGTTCG
 101 GGCACTCCGA CAAAGATGCC CTGCTCAACA GCAAAACCAG CCATGTCCGC
 151 GACGGCAAAC CGTCCGGCGG GCCAGTCATG ATGCCGAAAC CCCAACCGGC
 201 GGTCAAAAAA ACGGCAAAAT CCCAAGACCC CGCCATGCGC AACCTGCAAG
 251 AGCAGGATGC CGTCTACATC GCCAAGCAGA AACAGGCAAA AGCCTCCCCG
 301 TTCAAAACCG AAATCGAAAC CGCCTTGGAA GAAAGCGGCA TTATCGGCAA
 351 CTCCGCCCAC ACCGTTCCCG AACCCCAAAC CGGACATTCC GCACCAAAAC
 401 CTGCCGACGC GCCGGCAAAA CCTGTTCCCG TTCCGCAAAC GCCGGCAAAA
 451 CCGCTGATTA CGCTCAAAGA GCTGTCGAAG GTCGAGCTGC CCTGGTTTGA
 501 CGTGCGCTTC GACTTCATCT CTTATATCGC GCTGACCGAA GCCAAAGAAC
 551 TGCACGCACT GCCGCGCCTT TCCAACCGCT GCCGCTACCA GATTGTCGGC
 601 TGCACCATGG ACGACCATTT CCAGATTGCC GAACCCATCC CGGGCATCCG
 651 CTATCAGGCA TTTATCGTGG GTATTCAGGC AGTCAGCCGC AACGGACTTG
 701 CCTCGCAGGA AGAACTCTCC GCATTCAACC GCCAGGTGGA TGCATTCGCA
 751 CACAGCATGG GCGGTCAGAC GCTGCACACC GACCTTGCCG CCTTTATCGA
 801 AGTGGCTTCC GCACTGGACG CATTCTGCGC GCGCGTCGAC CAGACTATCG
 851 CCATCCATTT GGTTTCCCCG ACCAGCATCA GCGGCGTAGA ACTGCGTTCC
 901 GCCGTAACGG GCGTGGGTTT CGTTTTGGAA GACGACGGCG CGTTCCACTA
 951 TACCGACACG TCGGGCTCGA CCATGTTCTC CATCTGCTCG CTCAACAACG
1001 AGCCGTTTAC CAATGCCCTT TTGGACAACC AGTCCTATAA AGGCTTCAGT
1051 ATGCTGCTCG ACATCCCGCA CTCTCCGGCA GGCGAAAAAA CCTTCGACGA
1101 TTTGTTTATG GATTTGGCGG TACGCCTGTC CGGCCAGTTG AACCTGAATC
1151 TGGTCAACGA CAAAATGGAA GAAGTTTCGA CCCAATGGCT CAAAGACGTG
1201 CGCACTTATG TATTGGCTCG TCAGTCCGAG ATGCTCAAAG TCGGTATCGA
1251 ACCGGGCGGC AAAACCGCAT TGCGCCTGTT CTCCTAA
```

This encodes a protein having amino acid sequence <SEQ ID 528>:

```
  1 MIYIVLFLAA VLAVVAYNMY QENQYRKKVR DQFGHSDKDA LLNSKTSHVR

51 DGKPSGGPVM MPKPQPAVKK TAKSQDPAMR NLQEQDAVYI AKQKQAKASP

101 FKTEIETALE ESGIIGNSAH TVPEPQTGHS APKPADAPAK PVPVPQTPAK

151 PLITLKELSK VELPWFDVRF DFISYIALTE AKELHALPRL SNRCRYQIVG

201 CTMDDHFQIA EPIPGIRYQA FIVGIQAVSR NGLASQEELS AFNRQVDAFA

251 HSMGGQTLHT DLAAFIEVAS ALDAFCARVD QTIAIHLVSP TSISGVELRS

301 AVTGVGFVLE DDGAFHYTDT SGSTMFSICS LNNEPFTNAL LDNQSYKGFS

351 MLLDIPHSPA GEKTFDDLFM DLAVRLSGQL NLNLVNDKME EVSTQWLKDV

401 RTYVLARQSE MLKVGIEPGG KTALRLFS*
```

ORF119a and ORF119-1 show 98.6% identity in 428 aa overlap:

```
                      10         20         30         40         50         60
orf119a.pep   MIYIVLFLAAVLAVVAYNMYQENQYRKKVRDQFGHSDKDALLNSKTSHVRDGKPSGGPVM
              ||||||||:|||||||||||||||||||||||||||||||||||||||||||||||| ||
orf119-1      MIYIVLFLAVVLAVVAYNMYQENQYRKKVRDQFGHSDKDALLNSKTSHVRDGKPSGGSVM
                      10         20         30         40         50         60
                      70         80         90        100        110        120
orf119a.pep   MPKPQPAVKKTAKSQDPAMRNLQEQDAVYIAKQKQAKASPPFKTEIETALEESGIIGNSAH
              |||||||||||||:||||||||||||||||||||||||||||||||||||||||||||||
orf119-1      MPKPQPAVKKTAKPQDPAMRNLQEQDAVYIAKQKQAKASPPFKTEIETALEESGIIGNSAH
                      70         80         90        100        110        120
                     130        140        150        160        170        180
orf119a.pep   TVPEPQTGHSAPKPADAPAKPVPVPQTPAKPLITLKELSKVELPWFDVRFDFISYIALTE
              || ||||||||||||||||||:|||||||||||||||||||||||||||||||||||||
orf119-1      TVSEPQTGHSAPKPADAPAKPAPVPQTPAKPLITLKELSKVELPWFDVRFDFISYIALTE
                     130        140        150        160        170        180
                     190        200        210        220        230        240
orf119a.pep   AKELHALPRLSNRCRYQIVGCTMDDHFQIAEPIPGIRYQAFIVGIQAVSRNGLASQEELS
              ||||||||||||||||||||||||||||||||||||||||||||||||||||||||||||
orf119-1      AKELHALPRLSNRCRYQIVGCTMDDHFQIAEPIPGIRYQAFIVGIQAVSRNGLASQEELS
                     190        200        210        220        230        240
                     250        260        270        280        290        300
orf119a.pep   AFNRQVDAFAHSMGGQTLHTDLAAFIEVASALDAFCARVDQTIAIHLVSPTSISGVELRS
              ||||||||||:|||||||||||||||||||||||||||||||||||||||||||||||||
orf119-1      AFNRQVDAFAQSMGGQTLHTDLAAFIEVASALDAFCARVDQTIAIHLVSPTSISGVELRS
                     250        260        270        280        290        300
                     310        320        330        340        350        360
orf119a.pep   AVTGVGFVLEDDGAFHYTDTSGSTMFSICSLNNEPFTNALLDNQSYKGFSMLLDIPHSPA
              ||||||||||||||||||||||||||||||||||||||||||||||||||||||||||||
orf119-1      AVTGVGFVLEDDGAFHYTDTSGSTMFSICSLNNEPFTNALLDNQSYKGFSMLLDIPHSPA
                     310        320        330        340        350        360
                     370        380        390        400        410        420
orf119a.pep   GEKTFDDLFMDLAVRLSGQLNLNLVNDKMEEVSTQWLKDVRTYVLARQSEMLKVGIEPGG
              ||||||||||||||||||||||||||||||||||||||||||||||||||||||||||||
orf119-1      GEKTFDDLFMDLAVRLSGQLNLNLVNDKMEEVSTQWLKDVRTYVLARQSEMLKVGIEPGG
                     370        380        390        400        410        420
                     429
orf119a.pep   KTALRLFSX
              |||||||||
orf119-1      KTALRLFSX
```

Homology with a Predicted ORF from *N. gonorrhoeae*

ORF119 shows 93.1% identity over a 175aa overlap with a predicted ORF (ORF119ng) from *N. gonorrhoeae*:

```
orf119.pep   MIYIVLFLAVVLAVVAYNMYQENQYRKKVRDQFGHSDKDALLNSXTSHVRDGKPSGGSVM   60
             ||||||||:|||||||||||||||||||||||||||||||||||||||||||||||| ||
orf119ng     MIYIVLFLAAVLAVVAYNMYQENQYRKKVRDQFGHSDKDALLNSKTSHVRDGKPSGGPVM   60
orf119.pep   MPKPQPAVKKTAKPQDPXMRNLQEQDAVYIAKQKQAKASPPFKTEIETALEESGIIGNSAH  120
             ||||||||||| ||||| ||||||||||||||||||||||||||||||||| ||||||||
orf119ng     MPKPQPAVKKPAKPQDSAMRNLQEQDAVYIAKQKQAKASPPFKTEIETALEEIGIIGNSAH  120
```

```
orf119.pep    TVSEPQTGHSATKPADASAKPAPVPQTPAKPLITLKELSKVELSWFDVRIDFISY         175
              |||||||||||:||||||:||||:|||||||||||||||||||||| ||||| |||||
orf119ng      TVSEPQTGHSAPKPADAPAKPVPVPQTPAKPLITLKELSKVELPWFDVRFDFISYIALTE   180
```

The complete length ORF119ng nucleotide sequence <SEQ ID 529> is:

```
   1 ATGATTTACA TCGTACTGTT CCTCGCCGCC GTCCTCGCCG TTGTCGCCTA
  51 CAATATGTAT CAGGAAAACC AATACCGCAA AAAAGTGCGC GACCAGTTCG
 101 GACACTCCGA CAAAGATGCC CTGCTCAACA GCAAAACCAG CCATGTCCGC
 151 GACGGCAAAC CGTCCGGCGG GCCAGTCATG ATGCCGAAAC CCCAACCGGC
 201 GGTCAAAAAA CCGGCCAAAC CCAAGACTC CGCCATGCGC AACCTGCAAG
 251 AACAGGATGC CGTCTACATC GCCAAGCAGA AACAGGCAAA AGCCTCCCCG
 301 TTCAAAACCG AAATCGAAAC CGCCTTGGAA GAAATCGGCA TTATCGGCAA
 351 CTCCGCCCAC ACCGTTTCCG AACCCCAAAC CGGACATTCC GCACCGAAAC
 401 CTGCCGACGC GCCGGCAAAA CCCGTTCCCG TTCCGCAAAC GCCGGCAAAA
 451 CCGCTGATTA CGCTCAAAGA GCTGTCGAAG GTCGAGCTGC CCTGGTTTGA
 501 CGTGCGCTtc gACTTCATCT CCTATATCGC GCTGACCGAA GCCAAAGAAC
 551 TGCACGCACT GCCGCGCCTT tccAACCGCT GCCGCTACCA GATTGTCGGC
 601 TGCACCATGG ACGACCATTT CCAGATTGCC GAACCCATCC CGGGCATCCG
 651 CTATCAGGCA TTTATCGTGG GTATCCAGGC AGTCAGCCGC AACGGACTTG
 701 CCTCGCAGGA AGAACTCTCC GCATTCAACC GCCAGGCGGA CGCATTCGCA
 751 CAAAGCATGG CGGTCAGAC GCTGCACACC GACCTTGCCG CCTTTATCGA
 801 AGTGGCTTCC GCACTGGACG CATTCTGCGC GCGCGTCGAC CAGACCATCG
 851 CCATCCATTT GGTTTCGCCG ACCAGCATCA GCGGCGTAGA ACTGCGTTCC
 901 GCCGTAACGG GCGTGGGTTT CGTTTTGGAA GACGACGGCG CGTTCCACTA
 951 TACCGACACG TCGGGCTCGA CCATGTTCTC CATCTGCTCG CTCAACAACG
1001 AGCCGTTTAC CAATGCCCTT TTGGACAACC AGTCCTACAA AGGCTTCAGT
1051 ATGCTGCTCG ACATCCCGCA CTCTCCGGCA GGCGAAAAAA CCTTCGACGA
1101 TTTGTTTATG GATTTGGCGG TACGCCTGTC CGGTCAGTTG AACCTGAATC
1151 TGGTCAACGA CAAAATGGAA GAAGTTTCGA CCCAATGGCT CAAAGACGTA
1201 CGCACTTATG TATTGGCGCG TCAGTCCGAG ATGCTCAAAG TCGGTATCGA
1251 ACCGGGCGGC AAAACCGCCC TGCGCCTGTT TCATAA
```

This encodes a protein having amino acid sequence <SEQ ID 530>:

```
   1 MIYIVLFLAA VLAVVAYNMY QENQYRKKVR DQFGHSDKDA LLNSKTSHVR
  51 DGKPSGGPVM MPKPQPAVKK PAKPQDSAMR NLQEQDAVYI AKQKQAKASP
 101 FKTEIETALE EIGIIGNSAH TVSEPQTGHS APKPADAPAK PVPVPQTPAK
 151 PLITLKELSK VELPWFDVRF DFISYIALTE AKELHALPRL SNRCRYQIVG
 201 CTMDDHFQIA EPIPGIRYQA FIVGIQAVSR NGLASQEELS AFNRQADAFA
```

-continued

```
251 QSMGGQTLHT DLAAFIEVAS ALDAFCARVD QTIAIHLVSP TSISGVELRS

301 AVTGVGFVLE DDGAFHYTDT SGSTMFSICS LNNEPFTNAL LDNQSYKGFS

351 MLLDIPHSPA GEKTFDDLFM DLAVRLSGQL NLNLVNDKME EVSTQWLKDV

401 RTYVLARQSE MLKVGIEPGG KTALRLFS*
```

ORF119ng and ORF119-1 show 98.4% identity over 428 aa overlap:

```
                   10        20        30        40        50        60
orf119ng    MIYIVLFLAAVLAVVAYNMYQENQYRKKVRDQFGHSDKDALLNSKTSHVRDGKPSGGPVM
            |||||||||:||||||||||||||||||||||||||||||||||||||||||||||| ||
orf119-1    MIYIVLFLAVVLAVVAYNMYQENQYRKKVRDQFGHSDKDALLNSKTSHVRDGKPSGGSVM
                   10        20        30        40        50        60

70        80        90       100       110       120
orf119ng    MPKPQPAVKKPAKPQDSAMRNLQEQDAVYIAKQKQAKASPFKTEIETALEEIGIIGNSAH
            |||||||||| ||||| |||||||||||||||||||||||||||||||||| ||||||||
orf119-1    MPKPQPAVKKTAKPQDPAMRNLQEQDAVYIAKQKQAKASPFKTEIETALEESGIIGNSAH
                   70        80        90       100       110       120

130       140       150       160       170       180
orf119ng    TVSEPQTGHSAPKPADAPAKPVPVPQTPAKPLITLKELSKVELPWFDVRFDFISYIALTE
            |||||||||||||||||||||:||||||||||||||||||||||||||||||||||||||
orf119-1    TVSEPQTGHSAPKPADAPAKPAPVPQTPAKPLITLKELSKVELPWFDVRFDFISYIALTE
                  130       140       150       160       170       180

190       200       210       220       230       240
orf119ng    AKELHALPRLSNRCRYQIVGCTMDDHFQIAEPIPGIRYQAFIVGIQAVSRNGLASQEELS
            ||||||||||||||||||||||||||||||||||||||||||||||||||||||||||||
orf119-1    AKELHALPRLSNRCRYQIVGCTMDDHFQIAEPIPGIRYQAFIVGIQAVSRNGLASQEELS
                  190       200       210       220       230       240

250       260       270       280       290       300
orf119ng    AFNRQADAFAQSMGGQTLHTDLAAFIEVASALDAFCARVDQTIAIHLVSPTSISGVELRS
            |||||:||||||||||||||||||||||||||||||||||||||||||||||||||||||
orf119-1    AFNRQVDAFAQSMGGQTLHTDLAAFIEVASALDAFCARVDQTIAIHLVSPTSISGVELRS
                  250       260       270       280       290       300

310       320       330       340       350       360
orf119ng    AVTGVGFVLEDDGAFHYTDTSGSTMFSICSLNNEPFTNALLDNQSYKGFSMLLDIPHSPA
            ||||||||||||||||||||||||||||||||||||||||||||||||||||||||||||
orf119-1    AVTGVGFVLEDDGAFHYTDTSGSTMFSICSLNNEPFTNALLDNQSYKGFSMLLDIPHSPA
                  310       320       330       340       350       360

370       380       390       400       410       420
orf119ng    GEKTFDDLFMDLAVRLSGQLNLNLVNDKMEEVSTQWLKDVRTYVLARQSEMLKVGIEPGG
            ||||||||||||||||||||||||||||||||||||||||||||||||||||||||||||
orf119-1    GEKTFDDLFMDLAVRLSGQLNLNLVNDKMEEVSTQWLKDVRTYVLARQSEMLKVGIEPGG
                  370       380       390       400       410       420

429
orf119ng    KTALRLFSX
            |||||||||
orf119-1    KTALRLFSX
```

Based on this analysis, including the presence of a putative leader sequence in the gonococcal protein, it is predicted that the proteins from *N. meningitidis* and *N. gonorrhoeae*, and their epitopes, could be useful antigens for vaccines or diagnostics, or for raising antibodies.

Example 64

The following partial DNA sequence was identified in *N. meningitidis* <SEQ ID 531>

```
  1  ..GCGCGGCACG GCACGGAAGA TTTCTTCATG AACAACAGCG ACAC.ATCAG

51    GCAGATAGTC GAAAGCACCA CCGGTACGAT GAAGCTGCTG ATTTCCTCCA

101    TCGCCCTGAT TTCATTGGTA GTCGGCGGCA TCGGCGTGAT GAACATCATG

151    CTGGTGTCCG TTACCGAGCG CACCAAAGAA ATCGGCATAC GGATGGCAAT

201    CGGCGCGCGG CGCGGCAATA TTTyGCAGCA GTTTTTGATT GAGGCGGTGT
```

-continued

```
251    TAATCTGCGT CATCGGCGGT TTGGTCGGCG TGGGTTTGTC CGCCGCCGTC

301    AGCCTCGTGT TCAATCATTT TGTAACCGAC TTCCCGATGG ACATTTCCGC

351    CATGTCCGTC ATCGGCGCGG TCGCCTGTTC GACCGGAATC GGCATCGCGT

401    TCGGCTTTAT GCCTGCCAAT AAAGCAGCCA AACTCAATCC GATAGACGCA

451    TTGGCACAGG ATTGA
```

This corresponds to the amino acid sequence <SEQ ID 532; ORF134>:

```
1    ..ARHGTEDFFM NNSDXIRQIV ESTTGTMKLL ISSIALISLV VGGIGVMNIM

51   LVSVTERTKE IGIRMAIGAR RGNIXQQFLI EAVLICVIGG LVGVGLSAAV

101  SLVFNHFVTD FPMDISAMSV IGAVACSTGI GIAFGFMPAN KAAKLNPIDA

151  LAQD*
```

Further work revealed the complete nucleotide sequence <SEQ ID 533>:

```
   1 ATGTCGGTGC AAGCAGTATT GGCGCACAAA ATGCGTTCGC TTCTGACGAT

51 GCTCGGCATC ATCATCGGTA TCGCGTCGGT GGTTTCCGTC GTCGCATTGG

101 GCAATGGTTC GCAGAAAAAA ATCCTTGAAG ACATCAGTTC GATAGGGACG

151 AACACCATCA GCATCTTCCC GGGGCGCGGC TTCGGCGACA GGCGCAGCGG

201 CAGGATTAAA ACCCTGACCA TAGACGACGC AAAAATCATC GCCAAACAAA

251 GCTACGTTGC TTCCGCCACG CCCATGACTT CGAGCGGCGG CACGCTGACT

301 TACCGCAACA CCGACCTGAC CGCCTCGCTT TACGGCGTGG GCGAACAATA

351 TTTCGACGTG CGCGGACTGA AGCTGGAAAC GGGGCGGCTG TTTGACGAAA

401 ACGATGTGAA AGAAGACGCG CAGGTCGTCG TCATCGACCA AAATGTCAAA

451 GACAAACTCT TGCGGACTC GGATCCGTTG GGTAAAACCA TTTTGTTCAG

501 GAAACGCCCC TTGACCGTCA TCGGCGTGAT CAAAAAAGAC GAAAACGCTT

551 TCGGCAATTC CGACGTGCTG ATGCTTTGGT CGCCCTATAC GACGGTGATG

601 CACCAAATCA CAGGCGAGAG CCACACCAAC TCCATCACCG TCAAAATCAA

651 AGACAATGCC AATACCCAGG TTGCCGAAAA AGGGCTGACC GATCTGCTCA

701 AAGCGCGGCA CGGCACGGAA GATTTCTTCA TGAACAACAG CGACAGCATC

751 AGGCAGATAG TCGAAAGCAC CACCGGTACG ATGAAGCTGC TGATTTCCTC

801 CATCGCCCTG ATTTCATTGG TAGTCGGCGG CATCGGCGTG ATGAACATCA

851 TGCTGGTGTC CGTTACCGAG CGCACCAAAG AAATCGGCAT ACGGATGGCA

901 ATCGGCGCGC GGCGCGGCAA TATTTTGCAG CAGTTTTTGA TTGAGGCGGT

951 GTTAATCTGC GTCATCGGCG GTTTGGTCGG CGTGGGTTTG TCCGCCGCCG

1001 TCAGCCTCGT GTTCAATCAT TTTGTAACCG ACTTCCCGAT GGACATTTCC

1051 GCCATGTCCG TCATCGGCGC GGTCGCCTGT TCGACCGGAA TCGGCATCGC

1101 GTTCGGCTTT ATGCCTGCCA ATAAAGCAGC CAAACTCAAT CCGATAGACG

1151 CATTGGCACA GGATTGA
```

This corresponds to the amino acid sequence <SEQ ID 534; ORF134-1>:

```
  1 MSVQAVLAHK MRSLLTMLGI IIGIASVVSV VALGNGSQKK ILEDISSIGT

51 NTISIFPGRG FGDRRSGRIK TLTIDDAKII AKQSYVASAT PMTSSGGTLT

101 YRNTDLTASL YGVGEQYFDV RGLKLETGRL FDENDVKEDA QVVVIDQNVK

151 DKLFADSDPL GKTILFRKRP LTVIGVMKKD ENAFGNSDVL MLWSPYTTVM

201 HQITGESHTN SITVKIKDNA NTQVAEKGLT DLLKARHGTE DFFMNNSDSI

251 RQIVESTTGT MKLLISSIAL ISLVVGGIGV MNIMLVSVTE RTKEIGIRMA

301 IGARRGNILQ QFLIEAVLIC VIGGLVGVGL SAAVSLVFNH FVTDFPMDIS

351 AMSVIGAVAC STGIGIAFGF MPANKAAKLN PIDALAQD*
```

Computer analysis of this amino acid sequence gave the following results:

Homology with the Hypothetical Protein o648 of *E. coli* (Accession Number AE000189)

ORF134 and o648 protein show 45% aa identity in 153aa overlap:

```
Orf134:    2 RHGTEDFFMNNSDXIRQIVESTTGTMKXXXXXXXXXXXVVGGIGVMNIMLVSVTERTKEI  61
             RHG +DFF   N D + + VE TT T++           VVGGIGVMNIMLVSVTERT+EI
o648:    496 RHGKKDFFTWNMDGVLKTVEKTTRTLQLFLTLVAVISLVVGGIGVMNIMLVSVTERTREI  555

Orf134:   62 GIRMAIGARRGNIXQQFLIEAXXXXXXXXXXXXXXXXXXXXXXXXFNHFVTDFPMDISAMSVI 121
             GIRMA+GAR  ++ QQFLIEA                        F+  + +  S ++++
o648:    556 GIRMAVGARASDVLQQFLIEAVLCLVGGALGITLSLLIAFTLQLFLPGWEIGFSPLALL  615

Orf134:  122 GAVACSTGIGIAFGFMPANKAAKLNPIDALAQD                             154
             A  CST GI FG++PA  AA+L+P+DALA++
o648:    616 LAFLCSTVTGILFGWLPARNAARLDPVDALARE                             648
```

Homology with a Predicted ORF from *N. meningitidis* (Strain A)

ORF134 shows 98.7% identity over a 154aa overlap with an ORF (ORF134a) from strain A of *N. meningitidis*:

```
                                                    10         20         30
orf134.pep                                  ARHGTEDFFMNNSDXIRQIVESTTGTMKLL
                                            |||||||||||||| ||||||||||||||
orf134a    GESHTNSITVKIKDNANTQVAEKGLTDLLKARHGTEDFFMNNSDSIRQIVESTTGTMKLL
              210        220        230        240        250        260

40         50         60         70         80         90
orf134.pep  ISSIALISLVVGGIGVMNIMLVSVTERTKEIGIRMAIGARRGNIXQQFLIEAVLICVIGG
            ||||||||||||||||||||||||||||||||||||||||||| ||||||||||||||||
orf134a     ISSIALISLVVGGIGVMNIMLVSVTERTKEIGIRMAIGARRGNILQQFLIEAVLICVIGG
              270        280        290        300        310        320

100        110        120        130        140        150
orf134.pep  LVGVGLSAAVSLVFNHFVTDFPMDISAMSVIGAVACSTGIGIAFGFMPANKAAKLNPIDA
            ||||||||||||||||||||||||||||||||||||||||||||||||||||||||||||
orf134a     LVGVGLSAAVSLVFNHFVTDFPMDISAMSVIGAVACSTGIGIAFGFMPANKAAKLNPIDA
              330        340        350        360        370        380
```

```
orf134.pep  LAQDX
            |||||
orf134a     LAQDX
```

The complete length ORF134a nucleotide sequence <SEQ ID 535> is:

```
   1 ATGTCGGTGC AAGCAGTATT GGCGCACAAA ATGCGTTCGC TTCTGACGAT
  51 GCTCGGCATC ATCATCGGTA TCGCTTCGGT TGTCTCCGTC GTCGCATTGG
 101 GCAACGGTTC GCAGAAAAAA ATCCTTGAAG ACATCAGTTC GATAGGGACG
 151 AACACCATCA GCATCTTCCC AGGGCGCGGC TTCGGCGACA GGCGCAGCGG
 201 CAGGATTAAA ACCCTGACCA TAGACGACGC AAAAATCATC GCCAAACAAA
 251 GCTACGTTGC TTCCGCCACG CCCATGACTT CGAGCGGCGG CACGCTGACT
 301 TACCGCAATA CCGACCTGAC CGCTTCTTTG TACGGTGTGG CCGAACAATA
 351 TTTCGACGTG CGCGGGCTGA AGCTGGAAAC GGGGCGGCTG TTTGACGAAA
 401 ACGATGTGAA AGAAGACGCG CAGGTCGTCG TCATCGACCA AAATGTCAAA
 451 GACAAACTCT TTGCGGACTC GGATCCGTTG GGTAAAACCA TTTTGTTCAG
 501 GAAACGCCCC TTGACCGTCA TCGGCGTGAT GAAAAAAGAC GAAAACGCTT
 551 TCGGCAATTC CGACGTGCTG ATGCTTTGGT CGCCCTATAC GACGGTGATG
 601 CACCAAATCA CAGGCGAGAG CCACACCAAC TCCATCACCG TCAAAATCAA
 651 AGACAATGCC AATACCCAGG TTGCCGAAAA AGGGCTGACC GATCTGCTCA
 701 AAGCGCGGCA CGGCACGGAA GATTTCTTCA TGAACAACAG CGACAGCATC
 751 AGGCAGATAG TCGAAAGCAC CACCGGTACG ATGAAGCTGC TGATTTCCTC
 801 CATCGCCCTG ATTTCATTGG TAGTCGGCGG CATCGGCGTG ATGAACATCA
 851 TGCTGGTGTC CGTTACCGAG CGCACCAAAG AAATCGGCAT ACGGATGGCA
 901 ATCGGCGCGC GGCGCGGCAA TATTTTGCAG CAGTTTTTGA TTGAGGCGGT
 951 GTTAATCTGC GTCATCGGCG GTTTGGTCGG CGTGGGTTTG TCCGCCGCCG
1001 TCAGCCTCGT GTTCAATCAT TTTGTAACCG ACTTCCCGAT GGACATTTCC
1051 GCCATGTCCG TCATCGGCGC GGTCGCCTGT TCGACCGGAA TCGGCATCGC
1101 GTTCGGCTTT ATGCCTGCCA ATAAAGCAGC CAAACTCAAT CCGATAGATG
1151 CATTGGCGCA GGATTCA
```

This encodes a protein having amino acid sequence <SEQ ID 536>:

```
  1 MSVQAVLAHK MRSLLTMLGI IIGIASVVSV VALGNGSQKK ILEDISSIGT
 51 NTISIFPGRG FGDRRSGRIK TLTIDDAKII AKQSYVASAT PMTSSGGTLT
101 YRNTDLTASL YGVGEQYFDV RGLKLETGRL FDENDVKEDA QVVVIDQNVK
151 DKLFADSDPL GKTILFRKRP LTVIGVMKKD ENAFGNSDVL MLWSPYTTVM
201 HQITGESHTN SITVKIKDNA NTQVAEKGLT DLLKARHGTE DFFMNNSDSI
```

```
-continued
251 RQIVESTTGT MKLLISSIAL ISLVVGGIGV MNIMLVSVTE RTKEIGIRMA

301 IGARRGNILQ QFLIEAVLIC VIGGLVGVGL SAAVSLVFNH FVTDFPMDIS

351 AMSVIGAVAC STGIGIAFGF MPANKAAKLN PIDALAQD*
```

ORF134a and ORF134-1 show 100.0% identity in 388 aa overlap:

```
orf134a.pep   MSVQAVLAHKMRSLLTMLGIIIGIASVVSVVALGNGSQKKILEDISSIGTNTISIFPGRG
              ||||||||||||||||||||||||||||||||||||||||||||||||||||||||||||
orf134-1      MSVQAVLAHKMRSLLTMLGIIIGIASVVSVVALGNGSQKKILEDISSIGTNTISIFPGRG orf134a.pep   FGDRRSGRIKTLTIDDAKIIAKQSYVASATPMTSSGGTLTYRNTDLTASLYGVGEQYFDV
              ||||||||||||||||||||||||||||||||||||||||||||||||||||||||||||
orf134-1      FGDRRSGRIKTLTIDDAKIIAKQSYVASATPMTSSGGTLTYRNTDLTASLYGVGEQYFDV orf134a.pep   RGLKLETGRLFDENDVKEDAQVVVIDQNVKDKLFADSDPLGKTILFRKRPLTVIGVMKKD
              ||||||||||||||||||||||||||||||||||||||||||||||||||||||||||||
orf134-1      RGLKLETGRLFDENDVKEDAQVVVIDQNVKDKLFADSDPLGKTILFRKRPLTVIGVMKKD orf134a.pep   ENAFGNSDVLMLWSPYTTVMHQITGESHTNSITVKIKDNANTQVAEKGLTDLLKARHGTE
              ||||||||||||||||||||||||||||||||||||||||||||||||||||||||||||
orf134-1      ENAFGNSDVLMLWSPYTTVMHQITGESHTNSITVKIKDNANTQVAEKGLTDLLKARHGTE orf134a.pep   DFFMNNSDSIRQIVESTTGTMKLLISSIALISLVVGGIGVMNIMLVSVTERTKEIGIRMA
              ||||||||||||||||||||||||||||||||||||||||||||||||||||||||||||
orf134-1      DFFMNNSDSIRQIVESTTGTMKLLISSIALISLVVGGIGVMNIMLVSVTERTKEIGIRMA orf134a.pep   IGARRGNILQQFLIEAVLICVIGGLVGVGLSAAVSLVFNHFVTDFPMDISAMSVIGAVAC
              ||||||||||||||||||||||||||||||||||||||||||||||||||||||||||||
orf134-1      IGARRGNILQQFLIEAVLICVIGGLVGVGLSAAVSLVFNHFVTDFPMDISAMSVIGAVAC orf134a.pep   STGIGIAFGFMPANKAAKLNPIDALAQDX
              |||||||||||||||||||||||||||||
orf134-1      STGIGIAFGFMPANKAAKLNPIDALAQDX
```

Homology with a Predicted ORF from *N. gonorrhoeae*

ORF134 shows 96.8% identity over a 154aa overlap with a predicted ORF (ORF134.ng) from *N. gonorrhoeae*:

```
orf134.pep                        ARHGTEDFFMNNSDXIRQIVESTTGTMKLL   30
                                  ||||||||||||||||:|||||||||||||
orf134ng    GESHTNSITVKIKDNANTRVAEKGLEALLKARHGTEDFFMNNSDSIRQMVESTTGTMKLL  264 orf134.pep  ISSIALISLVVGGIGVMNIMLVSVTERTKEIGIRMAIGARRGNIXQQFLIEAVLICVIGG   90
            |||||||||||||||||||||||||||||||||||||||||||| ||||||||||:|||
orf134ng    ISSIALISLVVGGIGVMNIMLVSVTERTKEIGIRMAIGARRGNILQQFLIEAVLICIIGG  324 orf134.pep  LVGVGLSAAVSLVFNHFVTDFPMDISAMSVIGAVACSTGIGIAFGFMPANKAAKLNPIDA  150
            |||||||||||||||||||||||||||||| |||||||||||||||||||||||||||||
orf134ng    LVGVGLSAAVSLVFNHFVTDFPMDISAASVIGAVACSTGIGIAFGFMPANKAAKLNPIDA  384 orf134.pep  LAQD  154
            ||||
orf134ng    LAQD  388
```

The complete length ORF134ng nucleotide sequence <SEQ ID 537> is:

```
  1 ATGTCGGTGC AAGCAGTATT GGCGCACAAA ATGCGTTCGC TTCTGACCAT

51 GCTCGGCATC ATCATCGGTA TCGCTTCGGT TGTCTCCGTC GTCGCGCTGG

101 GCAACGGTTC GCAGAAAAAA ATCCTCGAAG ACATCAGTTC GATGGGGACG

151 AACACCATCA GCATCTTCCC CGGGCGCGGC TTCGGCGACA GGCGCAGCGG

201 CAAAATCAAA ACCCTGACCA TAGACGACGC AAAAATCATC GCCAAACAAA

251 GCTACGTTGC CTCCGCCACG CCCATGACTT CGAGCGGCGG CACGCTGACC

301 TACCGCAATA CCGACCTGAC CGCTTCTTTG TACGGTGTGG GCGAACAATA
```

```
-continued
 351 TTTCGACGTG CGCGGGCTGA AGCTGGAAAC GGGGCGGCTG TTTGATGAGA

401 ACGATGTGAA AGAAGACGCG CAAGTCGTCG TCATCGACCA AAATGTCAAA

451 GACAAACTCT TTGCGGACTC GGATCCGTTG GGTAAAACCA TTTTGTTCAG

501 GAAACGCCCC TTGACCGTCA TCGGCGTGAT GAAAAAGAC GAAAACGCTT

551 TCGGCAATTC CGACGTGCTG ATGCTTTGGT CGCCCTATAC GACGGTGATG

601 CACCAAATCA CAGGCGAGAG CCACACCAAC TCCATCACCG TCAAAATCAA

651 AGACAATGCC AATACCCGGG TTGCCGAAAA AGGGCTGGCC GAGCTGCTCA

701 AAGCACGGCA CGGCACGGAA GACTTCTTTA TGAACAACAG CGACAGCATC

751 AGGCAGATGG TCGAAAGCAC CACCGGTACG ATGAAGCTGC TGATTTCCTC

801 CATCGCCCTG ATTTCATTGG TAGTCGGCGG CATCGGTGTG ATGAACATTA

851 TGCTGGTGTC CGTTACCGAG CGCACCAAAG AAATCGGCAT ACGGATGGCA

901 ATCGGCGCGC GGCGCGGCAA TATTTTGCAG CAGTTTTTGA TTGAGGCGGT

951 GTTAATCTGC ATCATCGGAG GCTTGGTCGG CGTAGGTTTG TCCGCCGCCG

1001 TCAGCCTCGT GTTCAATCAT TTTGTAACCG ATTTCCCGAT GGACATTTCG

1051 GCGGCATCCG TTATCGGGGC GGTCGCCTGT TCGACCGGAA TCGGCATCGC

1101 GTTCGGCTTT ATGCCTGCCA ATAAGGCAGC CAAACTCAAT CCGATAGATG

1151 CATTGGCGCA GGATTGA
```

This encodes a protein having amino acid sequence <SEQ ID 538>:

```
  1 MSVQAVLAHK MRSLLTMLGI IIGIASVVSV VALGNGSQKK ILEDISSMGT

51 NTISIFPGRG FGDRRSGKIK TLTIDDAKII AKQSYVASAT PMTSSGGTLT

101 YRNTDLTASL YGVGEQYFDV RGLKLETGRL FDENDVKEDA QVVVIDQNVK

151 DKLFADSDPL GKTILFRKRP LTVIGVMKKD ENAFGNSDVL MLWSPYTTVM

201 HQITGESHTN SITVKIKDNA NTRVAEKGLA ELLKARHGTE DFFMNNSDSI

251 RQMVESTTGT MKLLISSIAL ISLVVGGIGV MNIMLVSVTE RTKEIGIRMA

301 IGARRGNILQ QFLIEAVLIC IIGGLVGVGL SAAVSLVFNH FVTDFPMDIS

351 AASVIGAVAC STGIGIAFGF MPANKAAKLN PIDALAQD*
```

ORF134ng and ORF134-1 show 97.9% identity in 388 aa overlap:

```
orf134ng   MSVQAVLAHKMRSLLTMLGIIIGIASVVSVVALGNGSQKKILEDISSMGTNTISIFPGRG
           ||||||||||||||||||||||||||||||||||||||||||||||:||||||||||||
orf134-1   MSVQAVLAHKMRSLLTMLGIIIGIASVVSVVALGNGSQKKILEDISSIGTNTISIFPGRG orf134ng   FGDRRSGKIKTLTIDDAKIIAKQSYVASATPMTSSGGTLTYRNTDLTASLYGVGEQYFDV
           |||||||:||||||||||||||||||||||||||||||||||||||||||||||||||||
orf134-1   FGDRRSGRIKTLTIDDAKIIAKQSYVASATPMTSSGGTLTYRNTDLTASLYGVGEQYFDV orf134ng   RGLKLETGRLFDENDVKEDAQVVVIDQNVKDKLFADSDPLGKTILFRKRPLTVIGVMKKD
           ||||||||||||||||||||||||||||||||||||||||||||||||||||||||||||
orf134-1   RGLKLETGRLFDENDVKEDAQVVVIDQNVKDKLFADSDPLGKTILFRKRPLTVIGVMKKD orf134ng   ENAFGNSDVLMLWSPYTTVMHQITGESHTNSITVKIKDNANTRVAEKGLAELLKARHGTE
           |||||||||||||||||||||||||||||||:|||||:||||||||
orf134-1   ENAFGNSDVLMLWSPYTTVMHQITGESHTNSITVKIKDNANTQVAEKGLTDLLKARHGTE
```

```
            -continued
orf134ng    DFFMNNSDSIRQMVESTTGTMKLLISSIALISLVVGGIGVMNIMLVSVTERTKEIGIRMA
            ||||||||||||:|||||||||||||||||||||||||||||||||||||||||||||||
orf134-1    DFFMNNSDSIRQIVESTTGTMKLLISSIALISLVVGGIGVMNIMLVSVTERTKEIGIRMA orf134ng    IGARRGNILQQFLIEAVLICIIGGLVGVGLSAAVSLVFNHFVTDFPMDISAASVIGAVAC
            |||||||||||||||||||||:||||||||||||||||||||||||||||| ||||||||
orf134-1    IGARRGNILQQFLIEAVLICVIGGLVGVGLSAAVSLVFNHFVTDFPMDISAMSVIGAVAC orf134ng    STGIGIAFGFMPANKAAKLNPIDALAQDX
            |||||||||||||||||||||||||||||
orf134-1    STGIGIAFGFMPANKAAKLNPIDALAQDX
```

ORF134ng also shows homology to an *E. coli* ABC transporter:

```
sp|P75831|YBJZ_ECOLI HYPOTHETICAL ABC TRANSPORTER ATP-BINDING PROTEIN
YBJZ >gi5 (AE000189) o648; similar to YBBA_HAEIN SW: P45247
[Escherichia coli] Length = 648
Score = 297 bits (753), Expect = 6e-80
Identities = 162/389 (41%), Positives = 230/389 (58%), Gaps = 1/389 (0%)

Query:   1 MSVQAVLAHKMRSLLTMLXXXXXXXXXXXXXXXLGNGSQKKILEDISSMGTNTISIFPGRG  60
           M+ +A+ A+KMR+LLTML               +G+ +++ +L DI S+GTNTI ++PG+
Sbjct: 260 MAWRALAANKMRTLLTMLGIIIGIASVVSIVVVGDAAKQMVLADIRSIGTNTIDVYPGKD 319

Query:  61 FGDRRSGKIKTLTIDDAKIIAKQSYVASATPMTSSGGTLTYRNTDLTASLYGVGEQYFDV 120
           FGD    + L  DD   I KQ +VASATP  S     L Y N D+ AS  GV    YF+V
Sbjct: 320 FGDDDDPQYQQALKYDDLIAIQKQPWVASATPAVSQNLRLRYNNVDVAASANGVSGDYFNV 379

Query: 121 RGLKLETGRLFDENDVKEDAQVVVIDQNVKDKLFAD-SDPLGKTILFRKRPLTVIGVMKK 179
            G+    G  F++   +   AQVVV+D N + +LF   +D +G+ IL    P   VIGV ++
Sbjct: 380 YGMTFSEGNTFNQEQLNGRAQVVVLDSNTRRQLFPHKADVVGEVILVGNMPARVIGVAEE 439

Query: 180 DENAFGNSDVLMLWSPYTTVMHQITGESHTNSITVKIKDNANTRVAEKGLAELLKARHGT 239
           ++  FG+S VL +W PY+T+   ++ G+S  NSITV++K+  ++   AE+  L  LL  RHG
Sbjct: 440 KQSMFGSSKVLRVWLPYSTMSGRVMGQSWLNSITVRVKEGFDSAEAEQQLTRLLSLRHGK 499

Query: 240 EDFFMNNSDSIRQMVESTTGTMKXXXXXXXXXXXXVVGGIGVMNIMLVSVTERTKEIGIRM 299
           +DFF  N D + + VE TT T++             VVGGIGVMNIMLVSVTERT+EIGIRM
Sbjct: 500 KDFFTWNMDGVLKTVEKTTRTLQLFLTLVAVISLVVGGIGVMNIMLVSVTERTREIGIRM 559

Query: 300 AIGARRGNILQQFLIEXXXXXXXXXXXXXXXXXXXXXXXXFNHFVTDFPMDISAASVIGAVA 359
           A+GAR  ++LQQFLIE                        F+ + + S +++ A
Sbjct: 560 AVGARASDVLQQFLIEAVLVCLVGGALGITLSLLIAFTLQLFLPGWEIGFSPLALLLAFL 619

Query: 360 CSTGIGIAFGFMPANKAAKLNPIDALAQD                                388
           CST GI FG++PA  AA+L+P+DALA++
Sbjct: 620 CSTVTGILFGWLPARNAARLDPVDALARE                                648
```

Based on this analysis, including the presence of the leader peptide and transmembrane regions in the gonococcal protein, it is predicted that these proteins from *N. meningitidis* and *N. gonorrhoeae*, and their epitopes, could be useful antigens for vaccines or diagnostics, or for raising antibodies.

Example 65

The following partial DNA sequence was identified in *N. meningitidis* <SEQ ID 539>:

```
  1 ..GGGACGGGAG CGATGCTGCT GCTGTTTTAC GCGGTAACGA T.CTGCCTTT
 51 GGCCACTGGC GTTACCCTGA GTTACACCTC GTCGATTTTT TTGGCGGTAT
101 TTTCCTTCCT GATTTTGAAA GAACGGATTT CCGTTTACAC GCAGGCGGTG
151 CTGCTCCTTG GTTTTGCCGG CGTTGGTATTG CTGCTTAATC CCTCGTTCCG
201 CAGCGGTCAG GAAACGGCGG CACTCGCCGG GCTGGCGGGC GGCGCGATGT
```

```
                 -continued
251 CCGGCTGGGC GTATTTGAAA GTGCGCGAAC TGTCTTTGGC GGGCGAACCC

301 GGCTGGCGCG TCGTGTTTTA CCTTTCCGTG ACAGGTGTGG CGATGTCGTC

351 GGTTTGGGCG ACGCTGACCG GCTGGCACAC CCTGTCCTTT CCATCGGCAG

401 TTTATCTGTC GTGCATCGGC GTGTCCGCGC TGATTGCCCA ACTGTCGATG

451 ACGCGCGCCT ACAAAGTCGG CGACAAATTC ACGGTTGCCT CGCTTTCCTA

501 TATGACCGTC GTTTTTTCCG CTCTGTCTGC CGCATTTTTT CTGGGCGAAG

551 AGCTTTTCTG GCAGGAAATA CTCGGTATGT GCATCATCAT CCTCAGCGGT

601 ATTTTGA
```

This corresponds to the amino acid sequence <SEQ ID 540; ORF135>:

```
  1 ..GTGAMLLLFY AVTILPLATG VTLSYTSSIF LAVFSFLILK ERISVYTQAV

51 LLLGFAGVVL LLNPSFRSGQ ETAALAGLAG GAMSGWAYLK VRELSLAGEP

101 GWRVVFYLSV TGVAMSSVWA TLTGWHTLSF PSAVYLSCIG VSALIAQLSM

151 TRAYKVGDKF TVASLSYMTV VFSALSAAFF LGEELFWQEI LGMCIIISAV

201 F*
```

Further work revealed the complete nucleotide sequence <SEQ ID 541>:

```
  1 ATGGATACCG CAAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA mCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACTGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCGTCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTCTG GCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 542; ORF135-1>:

```
  1 MDTAKKDILG SGWMLVAAAC FTIMNVLIKE ASAKFALGSG ELVFWRMLFS

51 TVALGAAAVL RRDXFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL GEELFWQEIL GMCIIILSGI LSSIRPTAFK QRLQSLFRQR

301 *
```

Computer analysis of this amino acid sequence gave the following results:

Homology with a Predicted ORF from *N. meningitidis* (Strain A)

ORF135 shows 99.0% identity over a 197aa overlap with an ORF (ORF135a) from strain A of *N. meningitidis*:

```
                                          10        20        30
orf135.pep                       GTGAMLLLFYAVTILPLATGVTLSYTSSIF
                                 |||||||||||| |||||||||||||||||
orf135a          STVALGAAAVLRRDTFRTPHWKNHLNRSMVGTGAMLLLFYAVTHLPLATGVTLSYTSSIF
              50        60        70        80        90       100
                    40        50        60        70        80        90
orf135.pep    LAVFSFLILKERISVYTQAVLLLGFAGVVLLLNPSFRSGQETAALAGLAGGAMSGWAYLK
              ||||||||||||||||||||||||||||||||||||||||||||||||||||||||||||
orf135a       LAVFSFLILKERISVYTQAVLLLGFAGVVLLLNPSFRSGQETAALAGLAGGAMSGWAYLK
             110       120       130       140       150       160
                   100       110       120       130       140       150
orf135.pep    VRELSLAGEPGWRVVFYLSVTGVAMSSVWATLTGWHTLSFPSAVYLSCIGVSALIAQLSM
              ||||||||||||||||||||||||||||||||||||||||||||||||||||||||||||
orf135a       VRELSLAGEPGWRVVFYLSVTGVAMSSVWATLTGWHTLSFPSAVYLSCIGVSALIAQLSM
             170       180       190       200       210       220
                   160       170       180       190       200
orf135.pep    TRAYKVGDKFTVASLSYMTVVFSALSAAFFLGEELFWQEILGMCIIISAVFX
              |||||||||||||||||||||||||||||||:||||||||||||||||
orf135a       TRAYKVGDKFTVASLSYMTVVFSALSAAFFLAEELFWQEILGMCIIILSGILSSIRPTAF
             230       240       250       260       270       280
orf135a       KQRLQSLFRQRX
             290       300
```

The complete length ORF135a nucleotide sequence <SEQ ID 543> is:

```
  1 ATGGATACCG CAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA CCTTCCGCAC

201 CCCCCATTGG AAAAACCACT TAAACCGCAG TATGGTCGGG ACGGGGCGA

251 TGCTGCTGCT GTTTTACGCG GTAACGCATC TGCCTTTGGC CACCGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA
```

-continued
```
501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This encodes a protein having amino acid sequence <SEQ ID 544>:

```
  1 MDTAKKDILG SGWMLVAAAC FTIMNVLIKE ASAKFALGSG ELVFWRMLFS

51 TVALGAAAVL RRDTFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 *
```

ORF135a and ORF135-1 show 99.3% identity in 300 aa overlap:

```
orf135a.pep   MDTAKKDILGSGWMLVAAACFTIMNVLIKEASAKFALGSELVFWRMLFSTVALGAAAVL
              |||||||||||||||||||||||||||||||||||||||||||||||||||||||||||
orf135-1      MDTAKKDILGSGWMLVAAACFTIMNVLIKEASAKFALGSELVFWRMLFSTVALGAAAVL orf135a.pep   RRDTFRTPHWKNHLNRSMVGTGAMLLLFYAVTHLPLATGVTLSYTSSIFLAVFSFLILKE
              |||:|||||||||||||||||||||||||||||||||||||||||||||||||||||||
orf135-1      RRDXFRTPHWKNHLNRSMVGTGAMLLLFYAVTHLPLATGVTLSYTSSIFLAVFSFLILKE orf135a.pep   RISVYTQAVLLLGFAGVVLLLNPSFRSGQETAALAGLAGGAMSGWAYLKVRELSLAGEPG
              ||||||||||||||||||||||||||||||||||||||||||||||||||||||||||||
orf135-1      RISVYTQAVLLLGFAGVVLLLNPSFRSGQETAALAGLAGGAMSGWAYLKVRELSLAGEPG orf135a.pep   WRVVFYLSVTGVAMSSVWATLTGWHTLSFPSAVYLSCIGVSALIAQLSMTRAYKVGDKFT
              ||||||||||||||||||||||||||||||||||||||||||||||||||||||||||||
orf135-1      WRVVFYLSVTGVAMSSVWATLTGWHTLSFPSAVYLSCIGVSALIAQLSMTRAYKVGDKFT orf135a.pep   VASLSYMTVVFSALSAAFFLAEELFWQEILGMCIIILSGILSSIRPTAFKQRLQSLFRQR
              |||||||||||||||||||:||||||||||||||||||||||||||||||||||||||||
orf135-1      VASLSYMTVVFSALSAAFFLGEELFWQEILGMCIIILSGILSSIRPTAFKQRLQSLFRQR
```

Homology with a Predicted ORF from *N. gonorrhoeae*

ORF135 shows 97% identity over a 201aa overlap with a predicted ORF (ORF135ng) from *N. gonorrhoeae*:

```
orf135.pep              GTGAMLLLFYAVTXLPLATGVTLSYTSSIF       30
                        |||||||||||| |||:|||||||||||||
orf135ng    STVALGAAAVLRRDTFRTPHWKNHLNRSMVGTGAMLLLFYAVTHLPLTTGVTLSYTSSIF  335
```

```
                   -continued
orf135.pep  LAVFSFLILKERISVYTQAVLLLGFAGVVLLLNPSFRSGQETAALAGLAGGAMSGWAYLK   90
            ||||||||||||||||||||||||||||||||||||||||| ||||||||||||||||||
orf135ng    LAVFSFLILKERISVYTQAVLLLGFAGVVLLLNPSFRSGQEPAALAGLAGGAMSGWAYLK  395 orf135.pep  VRELSLAGEPGWRVVFYLSVTGVAMSSVWATLTGWHTLSFPSAVYLSCIGVSALIAQLSM  150
            |||||||||||||||||||||||:||||||||||||||||||||||| ||||||||||||
orf135ng    VRELSLAGEPGWRVVFYLSATGVAMSSVWATLTGWHTLSFPSAVYLSGIGVSALIAQLSM  455 orf135.pep  TRAYKVGDKFTVASLSYMTVVFSALSAAFFLGEELFWQEILGMCIIISAVF  201
            ||||||||||||||||||||||||||||||||||||||||||||||||:|
orf135ng    TRAYKVGDKFTVASLSYMTVVFSALSAAFFLGEELFWQEILGMCIIISAAF  506
```

An ORF135ng nucleotide sequence <SEQ ID 545> was predicted to encode a protein having amino acid sequence <SEQ ID 546>:

```
  1 MPSEKAFRRH LRTASFQGLH LHHFHQKVGK CGIIGFGIHI FPTLLPAAQG

51 ILDIQLGLFR IDFAALAVYR RTQVDFIHTV IDGIASDQAF SEVVQILRRL

101 NLGHFTDTHL IAQARRFIAD FGNIRPMRRG EAKTFCRCFR FDGIDGIHGD

151 FRQCGHINRL APGKDCRNGK RDKVFFHTRH YNQVCLEKTN CSARKIKFRH

201 QKQAKTHSTS LAARFTIRPS LSQRPFMDTA KKDILGSGWM LVAAACFTVM

251 NVLIKEASAK FALGSGELVF WRMLFSTVTL GAAAVLRRDT FRTPHWKNHL

301 NRSMVGTGAM LLLFYAVTHL PLTTGVTLSY TSSIFLAVFS FLILKERISV

351 YTQAVLLLGF AGVVLLLNPS FRSGQEPAAL AGLAGGAMSG WAYLKVRELS

401 LAGEPGWRVV FYLSATGVAM SSVWATLTGW HTLSFPSAVY LSGIGVSALI

451 AQLSMTRAYK VGDKFTVASL SYMTVVFSAL SAAFFLGEEL FWQEILGMCI

501 IISAAF*
```

Further work revealed the following gonococcal sequence <SEQ ID 547>:

```
  1 ATGGATACCG CAAAAAAAGA CATTTTAGGA TCGGGCTGGA TGCTGGTGGC

51 GGCGGCCTGC TTCACCGTTA TGAACGTATT GATTAAAGAG GCATCGGCAA

101 AATTTGCCCT CGGCAGCGGC GAATTGGTCT TTTGGCGCAT GCTGTTTTCA

151 ACCGTTACGC TCGGTGCTGC CGCCGTATTG CGGCGCGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGAC AACCGGCGTT

301 ACCCTGAGTT ACACCTCGTC GATTTTTttg GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 CCGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGCAACC GGCGTGGCGA TGTCGTCGgt ttgggcgacg

601 Ctgaccggct ggCACAcccT GTCCTTTcca tcggcagttt ATCtgtCGGG

651 CATCGGCGTG tccgcgCtgA TTGCCCAaCT GtcgatgAcg cGCGcctaca 701 aaGTCGGCGA CAAATTCACG GTTGCCTCGC tttcctaTAt gaccgtcGTC
```

```
-continued
751 TTTTCCGCCC TGTCTGCCGC ATTTTTTCTg ggcgaagagc tttTCtggCA

801 GGAAATACTC GGTATGTGCA TCATTAtccT CAGCGGCATT TTGAGCAGCA

851 TCCGCCCCAT TGCCTTCAAA CAGCGGCTGC AAGCCCTCTT CCGCCAAAGA

901 TAA
```

This corresponds to the amino acid sequence <SEQ ID 548; ORF135ng-1>:

```
  1 MDTAKKDILG SGWMLVAAAC FTVMNVLIKE ASAKFALGSG
    ELVFWRMLFS

51 TVTLGAAAVL RRDTFRTPHW KNHLNRSMVG TGAMLLLFYA
    VTHLPLTTGV

101 TLSYTSSIFL AVFSFLILKE RISVYTQAVL LLGFAGVVLL
    LNPSFRSGQE

151 PAALAGLAGG AMSGWAYLKV RELSLAGEPG WRVVFYLSAT
    GVAMSSVWAT

201 LTGWHTLSFP SAVYLSGIGV SALIAQLSMT RAYKVGDKFT
    VASLSYMTVV

251 FSALSAAFFL GEELFWQEIL GMCIIILSGI LSSIRPIAFK
    QRLQALFRQR

301 *
```

ORF135ng-1 and ORF135-1 show 97.0% identity in 300 aa overlap:

```
orf135ng-1.pep  MDTAKKDILGSGWMLVAAACFTVMNVLIKEASAKFALGSGELVFWRMLFSTVTLGAAAVL
                ||||||||||||||||||||||:|||||||||||||||||||||||||||:||||||
orf135-1        MDTAKKDILGSGWMLVAAACFTIMNVLIKEASAKFALGSGELVFWRMLFSTVALGAAAVL
orf135ng-1.pep  RRDTFRTPHWKNHLNRSMVGTGAMLLLFYAVTHLPLTTGVTLSYTSSIFLAVFSFLILKE
                |||:||||||||||||||||||||||||||||||||:|||||||||||||||||||||||
orf135-1        RRDXFRTPHWKNHLNRSMVGTGAMLLLFYAVTHLPLATGVTLSYTSSIFLAVFSFLILKE
orf135ng-1.pep  RISVYTQAVLLLGFAGVVLLLNPSFRSGQEPAALAGLAGGAMSGWAYLKVRELSLAGEPG
                ||||||||||||||||||||||||||||| ||||||||||||||||||||||||||||||
orf135-1        RISVYTQAVLLLGFAGVVLLLNPSFRSGQETAALAGLAGGAMSGWAYLKVRELSLAGEPG
orf135ng-1.pep  WRVVFYLSATGVAMSSVWATLTGWHTLSFPSAVYLSGIGVSALIAQLSMTRAYKVGDKFT
                ||||||||:||||||||||||||||||||||||||||| ||||||||||||||||||||
orf135-1        WRVVFYLSVTGVAMSSVWATLTGWHTLSFPSAVYLSCIGVSALIAQLSMTRAYKVGDKFT
orf135ng-1.pep  VASLSYMTVVFSALSAAFFLGEELFWQEILGMCIIILSGILSSIRPIAFKQRLQALFRQR
                |||||||||||||||||||||||||||||||||||||||||||| |||||||:|||||
orf135-1        VASLSYMTVVFSALSAAFFLGEELFWQEILGMCIIILSGILSSIRPTAFKQRLQSLFRQR
```

Based on this analysis, including the presence of several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 66

The following DNA sequence was identified in *N. meningitidis* <SEQ ID 549>:

```
  1 ATGAAGCGGC GTATAGCCGT CTTCGTCCTG TTCCCGCAGA TAATCCGAGT

51 TTTGGGACAA CTGTTGCCGA AAATCGTCAA TACAGTTCCG GCACATCGGA
```

```
                            -continued
101 TGCTCTTCCA GATTTTCGGG ATGTTCTTTT TCTTCATACA CCAGCAATAT

151 CTGCCCGGGA TCGCCGAAAT CGATTCCCCA TGCGGCATCG TGTTCGGTGC

201 GCTCCTCTTC CGTCATCTGC CCGCGCATTG CCTGTATGGT AAAGCCGCCG

251 TAGGGGATGC CgTTGCACAC GAACATCCAG TCGCTGATGT CGTCAACCGG

301 AACGCAAACG cTTTCGCCTT GTTCGACATT GGTCAGTTCG CCsGGTTCAT

351 TGTTCAGCAC ACCGTAAATA TAAAGACCGT CAAAATAAAT ATCGTCGATC

401 CACATATGTT CGCAAATTTC GCCGTCTTCG CCGTCTTGGA AAAAGGGAC

451 TTTGACCATG GCAAAATCCA AGGCGGAAAT AATGCGGCGG CGTTCCCAAA

501 AAAGcTCGCG CCAAAAATAT TTGAATGTTT TACGGGCGCG TTCGTCGGCA

551 CGGTTTACCG GTTCGTCTGC CTGTTCTACA TAATAAATGA CGGAATCGCC

601 CATCATaTCT GCTCCTCAAC GTGTACGGTA TCTGTTTGCA CCTTACTGCG

651 GCTTTCTgcC kTCGGCATCC GATTCGGATT TGAAAAGTTC mmrwyATTCG

701 GAATAG
```

This corresponds to the amino acid sequence <SEQ ID 550; ORF136>:

```
  1 MKRRIAVFVL FPQIIRVLGQ LLPKIVNTVP AHRMLFQIFG MFFFFIHQQY

51 LPGIAEIDSP CGIVFGALLF RHLPAHCLYG KAAVGDAVAH EHPVADVVNR

101 NANAFALFDI GQFAXFIVQH TVNIKTVKIN IVDPHMFANF AVFAVLEKRD

151 FDHGKIQGGN NAAAFPKKLA PKIFECFTGA FVGTVYRFVC LFYIINDGIA

201 HHSAPQRVRY LFAPYCGFLP SASDSDLKSS XXSE*
```

Further work revealed the complete nucleotide sequence <SEQ ID 551>:

```
  1 ATGATGAAGC GGCGTATAGC CGTCTTCGTC CTGTTCCCGC AGATAATCCG

51 AGTTTTGGGA CAACTGTTGC CGAAAATCGT CAATACAGTT CCGGCACATC

101 GGATGCTCTT CCAGATTTTC GGGATGTTCT TTTCTTCAT ACACCAGCAA

151 TATCTGCCCG GGATCGCCGA AATCGATTCC CCATGCGGCA TCGTGTTCGG

201 TGCGCTCCTC TTCCGTCATC TGCCCGCGCA TTGCCTGTAT GGTAAAGCCG

251 CCGTAGGGGA TGCCGTTGCA CACGAACATC CAGTCGCTGA TGTCGTCAAC

301 CGGAACGCAA ACGCTTTCGC CTTGTTCGAC ATTGGTCAGT TCGCCGGGTT

351 CATTGTTCAG CACACCGTAA ATATAAAGAC CGTCAAAATA AATATCGTCG

401 ATCCACATAT GTTCGCAAAT TTCGCCGTCT TCGCCGTCTT GGAAAAAAGG

451 GACTTTGACC ATGGCAAAAT CCAAGGCGGA ATAATGCGG CGGCGTTCCC

501 AAAAAAGCTC GCGCCAAAAA TATTTGAATG TTTTACGGGC GCGTTCGTCG

551 GCACGGTTTA CCGGTTCGTC TGCCTGTTCT ACATAATAAA TGACGGAATC

601 GCCCATCATT CTGCTCCTCA ACGTGTACGG TATCTGTTTG CACCTTACTG

651 CGGCTTTCTG CCTTCGGCAT CCGATTCGGA TTTGAAAAGT TCCAAATATT

701 CGGAATAG
```

This corresponds to the amino acid sequence <SEQ ID 552; ORF136-1>:

```
  1 MMKRRIAVFV LFPQIIRVLG QLLPKIVNTV PAHRMLFQIF GMFFFFIHQQ

51 YLPGIAEIDS PCGIVFGALL FRHLPAHCLY GKAAVGDAVA HEHPVADVVN

101 RNANAFALFD IGQFAGFIVQ HTVNIKTVKI NIVDPHMFAN FAVFAVLEKR

151 DFDHGKIQGG NNAAAFPKKL APKIFECFTG AFVGTVYRFV CLFYIINDGI

201 AHHSAPQRVR YLFAPYCGFL PSASDSDLKS SKYSE*
```

Computer analysis of this amino acid sequence gave the following results:

Homology with a Predicted ORF from *N. meningitidis* (Strain A)

ORF136 shows 71.7% identity over a 237aa overlap with an ORF (ORF136a) from strain A of *N. meningitidis*:

```
                         10         20         30         40         50        59
    orf136.pep   MKRRIAVFVLFPQIIRVLGQLLPKIVNTVPAHRMLFQIFGMFFFFIHQQYLPGIAEIDS
                 ||||||||||: | ||:||||||||||||||||||| |||||||||||||||||||||
    orf136a      MMKRRIAVFVLLMQKIRILGQLLPKIVNTVPAHRMLFQXFGMFFFFIHQQYLPGIAEIDS
                          10         20         30         40         50         60

60         70         80         90        100        110       119
    orf136.pep   PCGIVFGALLFRHLPAHCLYGKAAVGDAVAHEHPVADVVNRNANAFALFDIGQFAXFIVQ
                 ||||||:||||  :||||||||||||||:|||||||||||||||||||||||||  ||||
    orf136a      PCGIVFGTLLLFRHXSTHCLYGKAAVGNAVAHEHPVADVVNRNANAFALFDIGQFAGFIVQ
                          70         80         90        100        110        120

120        130        140        150        160        170        180
    orf136.pep   HTVNIKTVKINIVDPHMFANFAVFAVLEKRDFDHGKIQGGNNAAAFPKKLAPKIFECFTG
                 |::|:|||||||||||||||||  |||||||   :|  :|   |    |   |  ::  :
    orf136a      HAINVKTVKINIVDPHMFANFAXFAVLEKRALTMAKSKXXXMRRRSQKSSRQKYLNVLRA
                          130        140        150        160        170        180

180        190        200        210        220        230
    orf136.pep   AFVGTVYRFVCLFYIINDGIAHH---SAPQRVRYLFAPYCGFLPSASDSDLKSSXXSEX
                 :  ||: |         :::   |||||||||||||||||||||||||||||  ||
    orf136a      R---SPARFTGLSACSTXXMTESPIISAPQRVRYLFAPYCGFLPSASDSDLKSSKYSEX
                          190        200        210        220        230
```

The complete length ORF136a nucleotide sequence <SEQ ID 553> is:

```
  1 ATGATGAAGC GGCGTATAGC CGTCTTCGTC CTGCTCATGC AGAAAATCCG

51 GATTTTGGGA CAACTGTTGC CGAAAATCGT CAATACAGTT CCGGCACATC

101 GGATGCTCTT CCAGATNTTC GGGATGTTCT TTTTCTTCAT ACACCAGCAA

151 TACCTGCCCG GGATCGCCGA AATCGATTCC CCATGCGGCA TCGTGTTCGG

201 TACGCTCCTC TTCCGTCATC NGTCCACGCA TTGCCTGTAT GGTAAAGCCG

251 CCGTAGGGAA TGCCGTTGCA CACGAACATC CAGTCGCTGA TGTCGTCAAC

301 CGGAACGCAA ACGCTTTCGC CTTGTTCGAC ATTGGTCAGT TCGCCGGGTT

351 CATTGTTCAG CACGCCATAA ATGTAAAGAC CGTCAAAATA AATATCGTCG

401 ATCCACATAT GTTCGCAAAT TTCGCCNTCT TCGCCGTCTT GGAAAAAAGG

451 GCTTTGACCA TGGCAAAATC TAAGGNGNNA NNGATGCGGC GGCGTTCCCA

501 AAAAAGCTCG CGCCAAAAAT ATTTGAATGT TTTGCGGGCG CGTTCGCCGG

551 CACGGTTTAC CGGTTTGTCT GCCTGTTCTA CATAATAAAT GACGGAATCG
```

-continued

```
601 CCCATCATAT CTGCTCCTCA ACGTGTACGG TATCTGTTTG CACCTTACTG

651 CGGCTTTCTG CCTTCGGCAT CCGATTCGGA TTTGAAAAGT TCCAAATATT

701 CGGAATAG
```

This encodes a protein having amino acid sequence <SEQ ID 554>:

```
  1 MMKRRIAVFV LLMQKIRILG QLLPKIVNTV PAHRMLFQXF GMFFFFIHQQ

51 YLPGIAEIDS PCGIVFGTLL FRHXSTHCLY GKAAVGNAVA HEHPVADVVN

101 RNANAFALFD IGQFAGFIVQ HAINVKTVKI NIVDPHMFAN FAXFAVLEKR

151 ALTMAKSKXX XMRRRSQKSS RQKYLNVLRA RSPARFTGLS ACST**MTES

201 PIISAPQRVR YLFAPYCGFL PSASDSDLKS SKYSE*
```

ORF136a and ORF136-1 show 73.1% identity in 238 aa overlap:

```
                     10        20        30        40        50        60
orf136a.pep  MMKRRIAVFVLLMQKIRILGQLLPKIVNTVPAHRMLFQXFGMFFFFIHQQYLPGIAEIDS
             ||||||||||: | ||:|||||||||||||||||||| ||||||||||||||||||||||
orf136-1     MMKRRIAVFVLFPQIIRVLGQLLPKIVNTVPAHRMLFQIFGMFFFFIHQQYLPGIAEIDS
                     10        20        30        40        50        60

70        80        90       100       110       120
orf136a.pep  PCGIVFGTLLFRHXSTHCLYGKAAVGNAVAHEHPVADVVNRNANAFALFDIGQFAGFIVQ
             ||||||:||||   :||||||||||||:||||||||||||||||||||||||||||||||
orf136-1     PCGIVFGALLFRHLPAHCLYGKAAVGDAVAHEHPVADVVNRNANAFALFDIGQFAGFIVQ
                     70        80        90       100       110       120

130       140       150       160       170       180
orf136a.pep  HAINVKTVKINIVDPHMFANFAXFAVLEKRALTMAKSKXXXMRRRSQKSSRQKYLNVLRA
             |::|:||||||||||||||||| ||||||| : :|:        |: | |:: ::
orf136-1     HTVNIKTVKINIVDPHMFANFAVFAVLEKRDFDHGKIQGGNNAAAFPKKLAPKIFECFTG
                    130       140       150       160       170       180

190       200       210       220       230
orf136a.pep  R---SPARFTGLSACSTXXMTESPIISAPQRVRYLFAPYCGFLPSASDSDLKSSKYSEX
              : ||: |    :  ::: |||||||||||||||||||||||||||||||||||||||
orf136-1     AFVGTVYRFVCLFYIINDGIAHH---SAPQRVRYLFAPYCGFLPSASDSDLKSSKYSEX
                       190       200       210       220       230
```

Homology with a Predicted ORF from *N. gonorrhoeae*

ORF136 shows 92.3% identity over a 234aa overlap with a predicted ORF (ORF136ng) from *N. gonorrhoeae*:

```
orf136.pep    MKRRIAVFVLFPQIIRVLGQLLPKIVNTVPAHRMLFQIFGMFFFFIHQQYLPGIAEIDS    59
              |||||||||: | ||:|||||||||||||||||||||||||||||||:||||||||||
orf136ng     MMKRRIAVFVLLMQKIRILGQLLPKIVNTVPAHRMLFQIFGMFFFFIHRQYLPGIAEIDS    60 orf136.pep    PCGIVFGALLFRHLPAHCLYGKAAVGDAVAHEHPVADVVNRNANAFALFDIGQFAXFIVQ   119
              | ||||| ||||||  |||||||||||||||||||||||||||||||||||||| ||||
orf136ng     PGGIVFGTLLFRHLSAHCLYGKAAVGDAVAHEHPVADVVNRNANAFALFDIGQSAGFIVQ   120 orf136.pep    HTVNIKTVKINIVDPHMFANFAVFAVLEKRDFDHGKIQGGNNAAAFPKKLAPKIFECFTG   179
              ||||||||||||||||||||||||||||||||||||||||||||||||||||||:|||||
orf136ng     HTVNIKTVKINIVDPHMFANFAVFAVLEKRDFDHGKIQGGNNAAAFPKKLAPKVFECFTG   180 orf136.pep    AFVGTVYRFVCLFYIINDGIAHHSAPQRVRYLFAPYCGFLPSASDSDLKSSXXSE        234
              |||:|||||||||||||||||||| |||||||||||||: |||||||||||||  ||
orf136ng     AFVGTVYRFVCLFYIINDGIAHHTAPQRVRYLFAPYRGFLPPASDSDLKSSKYSE        235
```

The complete length ORF136ng nucleotide sequence <SEQ ID 555> is:

```
  1 ATGATGAAGC GGCGTATAGC CGTCTTCGTC CTGCTCATGC AGAAAATCCG
 51 GATTTTGGGA CAACTGTTGC CGAAAATCGT CAATACAGTT CCGGCACATC
101 GGATGCTCTT CCAAATTTTC GGGATGTTCT TTTTCTTCAT ACACCGGCAA
151 TACCTGCCCG GGATCGCCGA AATCGATTCC CCAGGCGGTA TCGTGTTCGG
201 TACGCTCCTC TTCCGTCATC TGTCCGCGCA TTGCCTGTAC GGTAAAGCCG
251 CCGTAGGGGA TGCCGTTGCA CACGAACATC CAGTCGCTGA TGTCGCCAAC
301 CGGAACGCAA ACGCTTTCGC CTTGTTCGAC ATTGGTCAGT CCGCCGGGTT
351 CATTGTTCAG CACACCGTAA ATATAAAGAC CGTCAAAATA AATATCGTCG
401 ATCCACATAT GTTCGCAAAT TTCGCCGTCT TCGCCGTCTT GGAAAAAAGG
451 GACTTTGACC ATGGCAAAAT CCAAGGCGGA ATAATGCGG CGGCGTTCCC
501 AAAAAAGCTC GCGCCAAAAG TATTTGAATG TTTTACGGGC GCGTTCGCCG
551 GCACGGTTTA CCGGTTCGTC TGCCTGTTCT ACATAATAAA TGACGGAATC
601 GCCCATCATA CTGCTCCTCA ACGTGTACGG TATCTGTTTG CACCTTACCG
651 CGGTTTTCTA CCTCCGGCAT CCGATTCGGA TTTGAAAAGT TCCAAATATT
701 CGGAATAG
```

This encodes a protein having amino acid sequence <SEQ ID 556>:

```
  1 MMKRRIAVFV LLMQKIRILG QLLPKIVNTV PAHRMLFQIF GMFFFFIHRQ
 51 YLPGIAEIDS PGGIVFGTLL FRHLSAHCLY GKAAVGDAVA HEHPVADVAN
101 RNANAFALFD IGQSAGFIVQ HTVNIKTVKI NIVDPHMFAN FAVFAVLEKR
151 DFDHGKIQGG NNAAAFPKKL APKVFECFTG AFACTVYRFV CLFYIINDGI
201 AHHTAPQRVR YLFAPYRGFL PPASDSDLKS SKYSE*
```

ORF136ng and ORF136-1 show 93.6% identity in 235 aa overlap:

```
orf136ng   MMKRRIAVFVLLMQKIRILGQLLPKIVNTVPAHRMLFQIFGMFFFFIHRQYLPGIAEIDS
           ||||||||||:|||:||||||||||||||||||||||||||||||||||:|||||||||
orf136-1   MMKRRIAVFVLFPQIIRVLGQLLPKIVNTVPAHRMLFQIFGMFFFFIHQQYLPGIAEIDS orf136ng   PGGIVFGTLLFRHLSAHCLYGKAAVGDAVAHEHPVADVANRNANAFALFDIGQSAGFIVQ
           | ||||| ||||||||||||||||||||||||||||||||:|||||||||||||| ||||||
orf136-1   PCGIVFGALLFRHLPAHCLYGKAAVGDAVAHEHPVADVVNRNANAFALFDIGQFAGFIVQ orf136ng   HTVNIKTVKINIVDPHMFANFAVFAVLEKRDFDHGKIQGGNNAAAFPKKLAPKVFECFTG
           ||||||||||||||||||||||||||||||||||||||||||||||||||||||:|||||
orf136-1   HTVNIKTVKINIVDPHMFANFAVFAVLEKRDFDHGKIQGGNNAAAFPKKLAPKIFECFTG orf136ng   AFAGTVYRFVCLFYIINDGIAHHTAPQRVRYLFAPYRGFLPPASDSDLKSSKYSEX
           ||:|||||||||||||||||||||:|||||||||||| |||| ||||||||||||||
orf136-1   AFVGTVYRFVCLFYIINDGIAHHSAPQRVRYLFAPYCGFLPSASDSDLKSSKYSEX
```

Based on the presence of the putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 67

The following partial DNA sequence was identified in *N. meningitidis* <SEQ ID 557>:

```
  1 ATGGAAAATA TGGTAACGTT TTCAAAAATC AGACCGCTTT TGGCAATCGC
 51 CGCCGCCGCG TTGCTTGCCG CC.TGCGGAC GGCGGGAAAT AATGCTGTCC
101 GCAAGCCGGT GCAAACCGCC AAACCCGCCG CAGTGGTCGG TTTGGCACTC
151 GGTGGCGGCG CATCTAAAGG ATTTGCCCAT GTAGGTATTA TTAAGGTTTT
201 GAAAGAAAAC GGTATTCCTG TGAAGGTGGT TACCGGCACC TCCGCAGGTT
251 CGATTGTCGG CAACCTTTTT GCATCGGGTA TGTCGCCCGA CCGCCTCGAA
301 TTGGAAGCCG AAATTTTAGG CAAAACCGAT TTGGTCGATT TAACCTTGTC
351 CACCAATGGG TTTATCAAAG GCGCAAAGCT GCAAAATTAC ATCAACCGAA
401 AACTCCGCGG CATGCAGATT CAGCAGTTTC CCATCAAATT TGCCGCC..
```

This corresponds to the amino acid sequence <SEQ ID 558; ORF137>:

```
  1 MENMVTFSKI RPLLAIAAAA LLAAXRTAGN NAVRKPVQTA KPAAVVGLAL
 51 GGGASKGFAH VGIIKVLKEN GIPVKVVTGT SAGSIVGNLF ASGMSPDRLE
101 LEAEILGKTD LVDLTLSTNG FIKGAKLQNY INRKLRGMQI QQFPIKEAA..
```

Further work revealed the complete nucleotide sequence <SEQ ID 559>:

```
  1 ATGGAAAATA TGGTAACGTT TTCAAAAATC AGACCGCTTT TGGCAATCGC
 51 CGCCGCCGCG TTGCTTGCCG CCTGCGGCAC GGCGGGAAAT AATGCTGTCC
101 GCAAGCCGGT GCAAACCGCC AAACCCGCCG CAGTGGTCGG TTTGGCACTC
151 GGTGGCGGCG CATCTAAAGG ATTTGCCCAT GTAGGTATTA TTAAGGTTTT
201 GAAAGAAAAC GGTATTCCTG TGAAGGTGGT TACCGGCACA TCGGCAGGTT
251 CGATTGTCGG CAGCCTTTTT GCATCGGGTA TGTCGCCCGA CCGCCTCGAA
301 TTGGAAGCCG AAATTTTAGG CAAAACCGAT TTGGTCGATT TAACCTTGTC
351 CACCAGTGGT TTTATCAAAG GCGAAAAGCT GCAAAATTAC ATCAACCGAA
401 AAGTCGGCGG CAGGCAGATT CAGCAGTTTC CCATCAAATT TGCCGCCGTT
451 GCTACTGATT TTGAAACCGG CAAGGCCGTC GCTTTCAATC AGGGGAATGC
501 CGGGCAGGCT GTGCGCGCTT CCGCCGCCAT TCCCAATGTG TTCCAACCCG
551 TTATCATCGG CAGGCATACA TATGTTGACG GCGGTCTGTC GCAGCCCGTG
601 CCCGTCAGTG CCGCCCGGCG GCAGGGGCG AATTTCGTGA TTGCCGTCGA
651 TATTTCCGCC CGTCCGGGCA AAAACATCAG CCAAGGTTTC TTCTCTTATC
701 TCGATCAGAC GCTGAACGTA ATGAGCGTTT CTGCGTTGCA AAATGAGTTG
751 GGGCAGGCGG ATGTGGTTAT CAAACCGCAG GTTTTGGATT TGGGTGCAGT
801 CGGCGGATTC GATCAGAAAA AACGCGCCAT CCGGTTGGGT GAGGAGGCAG
851 CACGTGCCGC ATTGCCTGAA ATCAAACGCA AACTGGCGGC ATACCGTTAT
901 TGA
```

This corresponds to the amino acid sequence <SEQ ID 560; ORF137-1>:

```
  1 MENMVTFSKI RPLLAIAAAA LLAACGTAGN NAVRKPVQTA KPAAVVGLAL

51 GGGASKGFAH VGIIKVLKEN GIPVKVVTGT SAGSIVGSLF ASGMSPDRLE

101 LEAEILGKTD LVDLTLSTSG FIKGEKLQNY INRKVGGRQI QQFPIKFAAV

151 ATDFETGKAV AFNQGNAGQA VRASAAIPNV FQPVIIGRHT YVDGGLSQPV

201 PVSAARRQGA NFVIAVDISA RPGKNISQGF FSYLDQTLNV MSVSALQNEL

251 GQADVVIKPQ VLDLGAVGGF DQKKRAIRLG EEAARAALPE IKRKLAAYRY

301 *
```

Computer analysis of this amino acid sequence gave the following results:

Homology with a Predicted ORF from *N. meningitidis* (Strain A)

ORF137 shows 93.3% identity over a 149aa overlap with an ORF (ORF137a) from strain A of *N. meningitidis*:

```
                        10         20         30         40         50         60
          orf137.pep    MENMVTFSKIRPLLAIAAAALLAAXRTAGNNAVRKPVQTAKPAAVVGLALGGGASKGFAH
                        ||||||||||||||||||||||| ||||||:|||||||||||||||||||||||||||||
          orf137a       MENMVTFSKIRPLLAIAAAALLAACGTAGNNAARKPVQTAKPAAVVGLALGGGASKGFAH
                        10         20         30         40         50         60

70         80         90        100        110        120
          orf137.pep    VGIIKVLKENGIPVKVVTGTSAGSIVGNLFASGMSPDRLELEAEILGKTDLVDLTLSTNG
                        |||||||||||||||||||||||||||:||||||||||||||||||||||||||||||:|
          orf137a       VGIIKVLKENGIPVKVVTGTSAGSIVGSLFASGMSPDRLELEAEILGKTDLVDLTLSTSG
                        70         80         90        100        110        120

130        140       149
          orf137.pep    FIKGAKLQNYINRKLRGMQIQQFPIKFAA
                        ||||  ||||||||||: | :|||||||||
          orf137a       FIKGEKLQNYINRKVGGRRIQQFPIKFAAVATDFETGKAVAFNQGNAGQAVRASAAIPNV
                        130        140        150        160        170        180
```

The complete length ORF137a nucleotide sequence <SEQ ID 561> is:

```
  1 ATGGAAAATA TGGTAACGTT TTCAAAAATC AGACCGCTTT TGGCAATCGC

51 CGCCGCCGCG TTGCTTGCCG CCTGCGGCAC GGCGGGAAAT AATGCTGCCC

101 GCAAGCCGGT GCAAACCGCC AAACCCGCCG CAGTGGTCGG TTTGGCACTC

151 GGTGGCGGCG CATCTAAAGG ATTTGCCCAT GTAGGTATTA TTAAGGTTTT

201 GAAAGAAAAC GGTATTCCTG TGAAGGTGGT TACCGGCACA TCGGCAGGTT

251 CGATAGTCGG CAGCCTTTTT GCATCGGGTA TGTCGCCCGA CCGCCTCGAA

301 TTGGAAGCCG AAATTTTAGG TAAAACCGAT TTGGTCGATT TAACCTTGTC

351 CACCAGTGGT TTTATCAAAG GCGAAAAGCT GCAAAATTAC ATCAACCGAA

401 AAGTCGGCGG CAGGCGGATT CAGCAGTTTC CCATCAAATT TGCCGCCGTT

451 GCTACTGATT TTGAAACCGG CAAGGCCGTC GCTTTCAATC AAGGGAATGC

501 CGGGCAGGCT GTGCGCGCTT CCGCCGCCAT TCCCAATGTG TTCCAACCCG

551 TTATCATCGG CAGGCATACA TATGTTGACG GCGGTCTGTC GCAGCCCGTG

601 CCCGTCAGTG CCGCCCGGCG GCANGNNNNG NATNTCGTGA TTGCCGTCGA
```

-continued

```
651 TATTTCCGCC CGTCCGAGCA AAAACATCAG CCAAGGCTTC TTCTCTTATC

701 TCGATCAGAC GCTGAACGTA ATGAGCGTTT CCGCGTTGCA AAATGAGTTG

751 GGGCAGGCGG ATGTGGTTAT CAAACCGCAG GTTTTGGATT TGGGTGCAGT

801 CGGCGGATTC GATCAGAAAA ACGCGCCAT CCGGTTGGGT GAGGAGGCAG

851 CACGTGCCGC ATTGCCTGAA ATCAAACGCA AACTGGCGGC ATACCGTTAT

901 TGA
```

This encodes a protein having amino acid sequence <SEQ ID 562>:

```
  1 MENMVTFSKI RPLLAIAAAA LLAACGTAGN NAARKPVQTA KPAAVVGLAL

51 GGGASKGFAH VGIIKVLKEN GIPVKVVTGT SAGSIVGSLF ASGMSPDRLE

101 LEAEILGKTD LVDLTLSTSG FIKGEKLQNY INRKVGGRRI QQFPIKFAAV

151 ATDFETGKAV AFNQGNAGQA VRASAAIPNV FQPVIIGRHT YVDGGLSQPV

201 PVSAARRXXX XXVIAVDISA RPSRNISQGF FSYLDQTLNV MSVSALQNEL

251 GQADVVIKPQ VLDLGAVGGF DQKKRAIRLG EEAARAALPE IKRKLAAYRY

301 *
```

ORF137a and ORF137-1 show 97.3% identity in 300 aa overlap:

```
orf137a.pep    MENMVTFSKIRPLLAIAAAALLAACGTAGNNAARKPVQTAKPAAVVGLALGGGASKGFAH
               ||||||||||||||||||||||||||||||||:||||||||||||||||||||||||||
orf137-1       MENMVTFSKIRPLLAIAAAALLAACGTAGNNAVRKPVQTAKPAAVVGLALGGGASKGFAH
orf137a.pep    VGIIKVLKENGIPVKVVTGTSAGSIVGSLFASGMSPDRLELEAEILGKTDLVDLTLSTSG
               ||||||||||||||||||||||||||||||||||||||||||||||||||||||||||||
orf137-1       VGIIKVLKENGIPVKVVTGTSAGSIVGSLFASGMSPDRLELEAEILGKTDLVDLTLSTSG
orf137a.pep    FIKGEKLQNYINRKVGGRRIQQFPIKFAAVATDFETGKAVAFNQGNAGQAVRASAAIPNV
               |||||||||||||||||||:||||||||||||||||||||||||||||||||||||||||
orf137-1       FIKGEKLQNYINRKVGGRQIQQFPIKFAAVATDFETGKAVAFNQGNAGQAVRASAAIPNV
orf137a.pep    FQPVIIGRHTYVDGGLSQPVPVSAARRXXXXXVIAVDISARPSKNISQGFFSYLDQTLNV
               |||||||||||||||||||||||||||      |||||||:|||||||||||||||||
orf137-1       FQPVIIGRHTYVDGGLSQPVPVSAARRQGANFVIAVDISARPGKNISQGFFSYLDQTLNV
orf137a.pep    MSVSALQNELGQADVVIKPQVLDLGAVGGFDQKKRAIRLGEEAARAALPEIKRKLAAYRY
               ||||||||||||||||||||||||||||||||||||||||||||||||||||||||||||
orf137-1       MSVSALQNELGQADVVIKPQVLDLGAVGGFDQKKRAIRLGEEAARAALPEIKRKLAAYRY
```

Homology with a Predicted ORF from *N. gonorrhoeae*

ORF137 shows 89.9% identity over a 149aa overlap with a predicted ORF (ORF137ng) from *N. gonorrhoeae*:

```
orf137.pep  MENMVTFSKIRPLLAIAAAALLAAXRTAGNNAVRKPVQTAKPAAVVGLALGGGASKGFAH   60
            |||||||||:||||||||||||||   ||||||:|||||||||||||:||||||||||||
orf137ng    MENMVTFSKIRSFLAIAAAALLAACGTAGNNAARKPVQTAKPAAVVALALGGGASKGFAH   60
orf137.pep  VGIIKVLKENGIPVKVVTGTSAGSIVGNLFASGMSPDRLELEAEILGKTDLVDLTLSTNG  120
            :||:||||||||||||||||||||||::|||||||||||||||||||||||||||||||:|
orf137ng    IGIVKVLKENGIPVKVVTGTSAGSIVGSLLASGMSPDRLELEAEILGKTDLVDLTLSTSG  120
orf137.pep  FIKGAKLQNYINRKLRGMQIQQFPIKFAA                                149
            ||||:|||||||||||:|:|||||||||
orf137ng    FIKGEKLQNYINRKVGGRQIQQFPIKFAAVATDFETGKAVAFNQGNAGQAVRASAAIPNV  180
```

The complete length ORF137ng nucleotide sequence <SEQ ID 563> is:

```
  1 ATGGAAAATA TGGTAACGTT TTCAAAAATC AGATCATTTT TGGCAATCGC

51 CGCCGCCGCG TTGCTTGCCG CCTGCGGTAC GGCGGGAAAC AATGCCGCCC

101 GCAAGCCGGT GCAAACCGCC AAACCCGCCG CAGTGGTCGC TTTGGCACTC

151 GGTGGCGGCG CATCTAAAGG ATTTGCCCAT ATAGGAATTG TTAAGGTTTT

201 GAAAGAAAAC GGTATTCCTG TGAAGGTGGT TACCGGCACA TCGGCAGGTT

251 CGATAGTCGG CAGCCTTTTG GCATCGGGTA TGTCGCCCGA CCGCCTCGAA

301 TTGGAAGCCG AGATTTTAGG TAAAACCGAT TTAGTCGATT TAACCTTGTC

351 CACCAGTGGT TTTATCAAAG GCGAAAAGCT GCAAAATTAC ATCAACCGAA

401 AAGTCGGCGG CAGGCAGATT CAGCAGTTTC CCATCAAATT TGCCGCCGTT

451 GCCACTGATT TTGAAACCGG CAAGGCCGTC GCTTTCAATC AAGGGAATGC

501 CGGGCAGGCG GTTCGTGCTT CCGCCGCCAT TCCCAATGTG TTCCAGCCAG

551 TCATCATCGG CAGGCACAAA TATGTTGACG GCGGTCTGTC GCAGCCCGTG

601 CCCGTCAGTG CCGCTCGGCG GCAGGGGCGA AATTTCGTGA TTGCCGTCGA

651 TATTTCCGCA CGTCCGAGCA AAAATGTCGG TCAAGGTTTC TTCTCTTATC

701 TCGATCAGAC GCTGAACGTG ATGAGCGTTT CCGTGTTGCA AAACGAGTTG 751 gggcAGGCGG ATGTGGTTAT CAAACCGCag gtTTTGGATT TGGGTGCAGT

801 CGGCGGATTC GATCAGAAAA AGCGCGCCAT CCGGTTGGGC GAGGAGGCAG

851 CACGTGCCGC ATTGCCTGAA ATCAAACGCA AACTGGCGGC ATACCGTTAT

901 TGA
```

This encodes a protein having amino acid sequence <SEQ ID 564>:

```
  1 MENMVTFSKI RSFLAIAAAA LLAACGTAGN NAARKPVQTA KPAAVVALAL

51 GGGASKGFAH IGIVKVLKEN GIPVKVVTGT SAGSIVGSLL ASGMSPDRLE

101 LEAEILGKTD LVDLTLSTSG FIKGEKLQNY INRKVGGRQI QQFPIKFAAV

151 ATDFETGKAV AFNQGNAGQA VRASAAIPNV FQPVIIGRHK YVDGGLSQPV

201 PVSAARRQGA NFVIAVDISA RPSKNVGQGF FSYLDQTLNV MSVSVLQNEL

251 GQADVVIKPQ VLDLGAVGGF DQKKRAIRLG EEAARAALPE IKRKLAAYRY

301 *
```

ORF137ng and ORF137-1 show 96.0% identity in 300 aa overlap:

```
orf137ng    MENMVTFSKIRSFLAIAAAALLAACGTAGNNAARKPVQTAKPAAVVALALGGGASKGFAH
            ||||||||||:||||||||||||||||||:|||||||||||:||||||||||||||||||
orf137-1    MENMVTFSKIRPLLAIAAAALLAACGTAGNNAVRKPVQTAKPAAVVGLALGGGASKGFAH orf137ng    IGIVKVLKENGIPVKVVTGTSAGSIVGSLLASGMSPDRLELEAEILGKTDLVDLTLSTSG
            :||:||||||||||||||||||||||||||:|||||||||||||||||||||||||||||
orf137-1    VGIIKVLKENGIPVKVVTGTSAGSIVGSLFASGMSPDRLELEAEILGKTDLVDLTLSTSG orf137ng    FIKGEKLQNYINRKVGGRQIQQFPIKFAAVATDFETGKAVAFNQGNAGQAVRASAAIPNV
            ||||||||||||||||||||||||||||||||||||||||||||||||||||||||||||
orf137-1    FIKGEKLQNYINRKVGGRQIQQFPIKFAAVATDFETGKAVAFNQGNAGQAVRASAAIPNV
```

```
orf137ng  FQPVIIGRHKYVDGGLSQPVPVSAARRQGANFVIAVDISARPSKNVGQGFFSYLDQTLNV
          ||||||||| ||||||||||||||||||||||||||||||| ||::||||||||||||||
orf137-1  FQPVIIGRHTYVDGGLSQPVPVSAARRQGANFVIAVDISARPGKNISQGFFSYLDQTLNV orf137ng  MSVSVLQNELGQADVVIKPQVLDLGAVGGFDQKKRAIRLGEEAARAALPEIKRKLAAYRY
          ||||:|||||||||||||||||||||||||||||||||||||||||||||||||||||||
orf137    MSVSALQNELGQADVVIKPQVLDLGAVGGFDQKKRAIRLGEEAARAALPEIKRKLAAYRY
```

Based on the presence of a predicted prokaryotic membrane lipoprotein lipid attachment site (underlined) in the gonococcal protein, it is predicted that the proteins from *N. meningitidis* and *N. gonorrhoeae*, and their epitopes, could be useful antigens for vaccines or diagnostics, or for raising antibodies.

Example 68

The following partial DNA sequence was identified in *N. meningitidis* <SEQ ID 565>:

```
  1 ATGTTTCGTT TACAATTCAG GCTGTTTCCC CCTTTGCGAA
    CCGCCATGCA

51 CATCCTGTTG ACCGCCCTGC TCAAATGCCT CTCCCTGcTG
    CCGCTTTCCT

101 GTCTGCACAC GCTGGGAAAC CGGCTCGGAC ATCTGGCGTT
    TTACCTTTTA

151 AAGGAAGACC GCGCGCGCAT CGTCGCCmAT ATGCGGCAGG
    CGGGTTTGAA

201 CCCCGACCCC AAAACGGTCA AGCCGTTTT  TGCGGAAACG
    GCAAAAGGCG

251 GTTTGGAACT TGCCCCCGCG TTTTTCAGAA AACCGGAAGA
    CATAGAAACA

301 ATGTTCAAAG CGGTACACGG CTGGGAACAT GTGCAGCAGG
    CTTTGGACAA

351 ACACGAAGGG CTGCTATTC...
```

This corresponds to the amino acid sequence <SEQ ID 566; ORF138>:

```
  1 MFRLQFRLFP PLRTAMHILL TALLKCLSLL PLSCLHTLGN
    RLGHLAFYLL

51 KEDRARIVAX MRQAGLNPDP KTVKAVFAET AKGGLELAPA
    FFRKPEDIET

101 MFKAVHCWEH VQQALDKHEG LLF
```

Further work revealed the complete nucleotide sequence <SEQ ID 567>:

```
  1 ATGTTTCGTT TACAATTCAG GCTGTTTCCC CCTTTGCGAA
    CCGCCATGCA

51 CATCCTGTTG ACCGCCCTGC TCAAATGCCT CTCCCTGCTG
    CCGCTTTCCT

101 GTCTGCACAC GCTGGGAAAC CGGCTCGGAC ATCTGGCGTT
    TTACCTTTTA

151 AAGGAAGACC GCGCGCGCAT CGTCGCCAAT ATGCGGCAGG
    CGGGTTTGAA

201 CCCCGACCCC AAAACGGTCA AGCCGTTTT  TGCGGAAACG
    GCAAAAGGCG

251 GTTTGGAACT TGCCCCCGCG TTTTTCAGAA AACCGGAAGA
    CATAGAAACA

301 ATGTTCAAAG CGGTACACGG CTGGGAACAT GTGCAGCAGG
    CTTTGGACAA

351 ACACGAAGGG CTGCTATTCA TCACGCCGCA CATCGGCAGC
    TACGATTTGG

401 GCGGACGCTA CATCAGCCAG CAGCTTCCGT TCCCGCTGAC
    CGCCATGTAC

451 AAACCGCCGA AAATCAAAGC GATAGACAAA ATCATGCAGG
    CGGGCAGGGT

501 TCGCGGCAAA GGAAAAACCG CGCCTACCAG CATACAAGGG
    GTCAAACAAA

551 TCATCAAAGC CCTGCGTTCG GGCGAAGCAA CCATCGTCCT
    GCCCGACCAC

601 GTCCCCTCCC CTCAAGAAGG CGGGGAAGGC GTATGGGTGG
    ATTTCTTCGG

651 CAAACCTGCC TATACCATGA CGCTGGCGGC AAAATTGGCA
    CACGTCAAAG

701 GCGTGAAAAC CCTGTTTTTC TGCTGCGAAC GCCTGCCTGG
    CGGACAAGGT

751 TTCGATTTGC ACATCCGCCC CGTCCAAGGG GAATTGAACG
    GCGACAAAGC

801 CCATGATGCC GCCGTGTTCA ACCGCAATGC CGAATATTGG
    ATACGCCGTT

851 TTCCGACGCA GTATCTGTTT ATGTACAACC GCTACAAAAT
    GCCGTAA
```

This corresponds to the amino acid sequence <SEQ ID 568; ORF138-1>:

```
  1 MFRLQFRLFP PLRTAMHILL TALLKCLSLL PLSCLHTLGN
    RLGHLAFYLL

51 KEDRARIVAN MRQAGLNPDP KTVKAVFAET AKGGLELAPA
    FFRKPEDIET

101 MFKAVHGWEH VQQALDKHEG LLFITPHIGS YDLGGRYISQ
    QLPFPLTAMY

151 KPPKIKAIDK IMQAGRVRGK GKTAPTSIQG VKQIIKALRS
    GEATIVLPDH

201 VPSPQEGGEG VWVDFFGKPA YTMTLAAKLA HVKGVKTLFF
    CCERLPGGQG

251 FDLHIRFVQG ELNGDKAHDA AVFNRNAEYW IRRFPTQYLF
    MYNRYKMP*
```

Computer analysis of this amino acid sequence gave the following results:

Homology with a Predicted ORF from *N. meningitidis* (Strain A)

ORF138 shows 99.2% identity over a 123aa overlap with an ORF (ORF138a) from strain A of *N. meningitidis*:

```
                10         20         30         40         50         60
orf138.pep  MFRLQFRLFPPLRTAMHILLTALLKCLSLLPLSCLHTLGNRLGHLAFYLLKEDRARIVAX
            ||||||||||||||||||||||||||||||||||||||||||||||||||||||||||| 
orf138a     MFRLQFRLFPPLRTAMHILLTALLKCLSLLPLSCLHTLGNRLGHLAFYLLKEDRARIVAN
                10         20         30         40         50         60

70         80         90        100        110        120
orf138.pep  MRQAGLNPDPKTVKAVFAETAKGGLELAPAFFRKPEDIETMFKAVHGWEHVQQALDKHEG
            ||||||||||||||||||||||||||||||||||||||||||||||||||||||||||||
orf138a     MRQAGLNPDPKTVKAVFAETAKGGLELAPAFFRKPEDIETMFKAVHGWEHVQQALDKHEG
                70         80         90        100        110        120 orf138.pep  LLF
            |||
orf138a     LLFITPHIGSYDLGGRYISQQLPFPLTAMYKPPKIKAIDKIMQAGRVRGKGKTAPTSIQG
                130        140        150        160        170        180
```

The complete length ORF138a nucleotide sequence <SEQ ID 569> is:

```
  1 ATGTTTCGTT TACAATTCAG GCTGTTTCCC CCTTTGCGAA CCGCCATGCA
 51 CATCCTGTTG ACCGCCCTGC TCAAATGCCT CTCCCTGCTG CCGCTTTCCT
101 GTCTGCACAC GCTGGGAAAC CGGCTCGGAC ATCTGGCGTT TTACCTTTTA
151 AAGGAAGACC GCGCGCGCAT CGTCGCCAAT ATGCGTCAGG CAGGCATGAA
201 TCCCGACCCC AAAACGGTCA AAGCCGTTTT TGCGGAAACG GCAAAAGGCG
251 GTTTGGAACT TGCCCCCGCG TTTTTCAGAA AACCGGAAGA CATAGAAACA
301 ATGTTCAAAG CGGTACACGG CTGGGAACAT GTGCAGCAGG CTTTGGACAA
351 ACACGAAGGG CTGCTATTCA TCACGCCGCA CATCGGCAGC TACGATTTGG
401 GCGGACGCTA CATCAGCCAG CAGCTTCCGT TCCCGCTGAC CGCCATGTAC
451 AAACCGCCGA AAATCAAAGC GATAGACAAA ATCATGCAGG CGGGCACGGT
501 TCGCGGCAAA GGAAAAACCG CGCCTACCAG CATACAAGGG GTCAAACAAA
551 TCATCAAAGC CCTGCGTTCG GGCGAAGCAA CCATCGTCCT GCCCGACCAC
601 GTCCCCTCCC CTCAAGAAGG CGGGGAAGGC GTATGGGTGG ATTTCTTCGG
651 CAAACCTGCC TATACCATGA CGCTGGCGGC AAAATTGGCA CACGTCAAAG
701 GCGTGAAAAC CCTGTTTTTC TGCTGCGAAC GCCTGCCTGG CGGACAAGGT
751 TTCGATTTGC ACATCCGCCC CGTCCAAGGG GAATTGAACG GCGACAAAGC
801 CCATGATGCC GCCGTGTTCA ACCGCAATGC CGAATATTGG ATACGCCGTT
851 TTCCGACGCA GTATCTGTTT ATGTACAACC GCTACAAAAT GCCGTAA
```

This encodes a protein having amino acid sequence <SEQ ID 570>:

```
  1 MFRLQFRLFP PLRTAMHILL TALLKCLSLL PLSCLHTLGN RLGHLAFYLL
 51 KEDRARIVAN MRQAGLNPDP KTVKAVFAET AKGGLELAPA FFRKPEDIET
101 MFKAVHGWEH VQQALDKHEG LLFITPHIGS YDLGGRYISQ QLPFPLTAMY
151 KPPKIKAIDK IMQAGRVRGK GKTAPTSIQG VKQIIKALRS GEATIVLPDH
201 VPSPQEGGEG VWVDFFGKPA YTMTLAAKLA HVKGVKTLFF CCERLPGGQG
251 FDLHIRPVQG ELNGDKAHDA AVFNRNAEYW IRRFPTQYLF MYNRYKMP*
```

ORF138a and ORF138-1 show 99.7% identity over a 298aa overlap:

```
orf138a.pep  MFRLQFRLFPPLRTAMHILLTALLKCLSLLPLSCLHTLGNRLGHLAFYLLKEDRARIVAN
             ||||||||||||||||||||||||||||||||||||||||||||||||||||||||||||
orf138-1     MFRLQFRLFPPLRTAMHILLTALLKCLSLLPLSCLHTLGNRLGHLAFYLLKEDRARIVAN orf138a.pep  MRQAGMNPDPKTVKAVFAETAKGGLELAPAFFRKPEDIETMFKAVHGWEHVQQALDKHEG
             |||||:||||||||||||||||||||||||||||||||||||||||||||||||||||||
orf138-1     MRQAGLNPDPKTVKAVFAETAKGGLELAPAFFRKPEDIETMFKAVHGWEHVQQALDKHEG
```

```
                    -continued
orf138a.pep  LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||||
orf138-1     LLFITPHIGSYDLGGRYISQQLPFPLTAMYKPPKIKAIDKIMQAGRVRGKGKTAPTSIQG orf138a.pep  VKQIIKALRSGEATIVLPDHVPSPQEGGEGVWVDFFGKPAYTMTLAAKLAHVKGVKTLFF
             ||||||||||||||||||||||||||||||||||||||||||||||||||||||||||||
orf138-1     VKQIIKALRSGEATIVLPDHVPSPQEGGEGVWVDFFGKPAYTMTLAAKLAHVKGVKTLFF orf138a.pep  CCERLPGGQGFDLHIRPVQGELNGDKAHDAAVFNRNAEYWIRRFPTQYLFMYNRYKMP
             |||||||||||||||||||||||||||||||||||||||||||||||||||||||||
orf138-1     CCERLPGGQGFDLHIRPVQGELNGDKAHDAAVFNRNAEYWIRRFPTQYLFMYNRYKMP
```

Homology with a Predicted ORF from *N. gonorrhoeae*

ORF138 shows 94.3% identity over a 123aa overlap with a predicted ORF (ORF138ng) from *N. gonorrhoeae*:

```
orf138.pep   MFRLQFRLFPPLRTAMHILLTALLKCLSLLPLSCLHTLGNRLGHLAFYLLKEDRARIVAX    60
             |||||||||||||||||||||||||||||||| |||||||||||||||||||||||||||
orf138ng     MFRLQFRLFPPLRTAMHILLTALLKCLSLLSLSCLHTLGNRLGHLAFYLLKEDRARIVAN    60 orf138.pep   MRQAGLNPDPKTVKAVFAETAKGGLELAPAFFRKPEDIETMFKAVHGWEHVQQALDKHEG   120
             |||||||||| :||||||||||||| ||||||||:|||||||||||||||||||||| ||
orf138ng     MRQAGLNPDTQTVKAVFAETAKCGLELAPAFFKKPEDIETMFKAVHGWEHVQQALDKGEG   120 orf138.pep   LLF                                                            123
             |||
orf138ng     LLFITPHIGSYDLGGRYISQQLPFHLTAMYKPPKIKAIDKIMQAGRVRGKGKTAPTGIQG   180
```

The complete length ORF138ng nucleotide sequence <SEQ ID 571> is:

```
  1 ATGTTTCGTT TACAATTCAG GCTGTTTCCC CCTTTGCGAA
    CCGCCATGCA
 51 CATCCTGTTG ACCGCCCTGC TCAAATGCCT CTCCCTGCTG
    TCGCTTTCCT
101 GTCTGCACAC GCTGGGAAAC CGGCTCGGAC ATCTGGCGTT
    TTACCTTTTA
151 AAGGAAGACC GCGCGCGCAT CGTCGCCAAT ATGCGGCAGG
    CGGGTTTGAA
201 CCCCGACACG CAGACGGTCA AAGCCGTTTT TGCGGAAACG
    GCAAAATGCG
251 GTTTGGAACT TGCCCCCGCG TTTTTCAAAA AACCGGAAGA
    CATCGAAACA
301 ATGTTCAAAG CGGTACACGG CTGGGAACAC GTGCAGCAGG
    CTTTGGACAA
351 GGGCGAAGGG CTGCTGTTCA TCACGCCGCA CATCGGCAGC
    TACGATTTGG
401 GCGGACGCTA CATCAGCCAG CAGCTTCCGT TCCACCTGAC
    CGCCATGTAC
451 AAGCCGCCGA AAATCAAAGC GATAGACAAA ATCATGCAGG
    CGGGCAGGGT
501 GCGCGGCAAA GGCAAAACcg cgcccaccgg catACAAGGG
    GTCAAACAAA
551 tcatcaAGGC CCTGCGCGCG GGCGAGGCAA CCAtcATCCT
    GCCCGACCAC
601 GTCCCTTCTC CGCAGGAagg cggCGGCGTG TGGGCGGATT
    TTTTCGGCAA
651 ACCTGCATAc acCATGACAC TGGCGGCAAA ATTGGCACAC
    GTCAAAGGCG
701 TGAAAACCCT GTTTTTCTGC TGCGAACGCC TGCCCGACGG
    ACAAGGCTTC
751 GTGTTGCACA TCCGCCCCGT CCAAGGGGAA TTGAACGGCA
    ACAAAGCCCA
801 CGATGCCGCC GTGTTCAACC GCAATACCGA ATATTGGATA
    CGCCGTTTTC
851 CGACGCAGTA TCTGTTTATG TACAACCGCT ATAAAACGCC
    GTAA
```

This encodes a protein having amino acid sequence <SEQ ID 572>:

```
  1 MFRLQFRLFP PLRTAMHILL TALLKCLSLL SLSCLHTLGN
    RLGHLAFYLL
 51 KEDRARIVAN MRQAGLNPDT QTVKAVFAET AKCGLELAPA
    FFKKPEDIET
101 MFKAVHGWEH VQQALDKGEG LLFITPHIGS YDLGGRYISQ
    QLPFHLTAMY
151 KPPKIKAIDK IMQAGRVRGK GKTAPTGIQG VKQIIKALRA
    GEATIILPDH
201 VPSPQEGGGV WADFFGKPAY TMTLAAKLAH VKGVKTLFFC
    CERLPDGQGF
251 VLHIRPVQGE LNGNKAHDAA VFNRNTEYWI RRFPTQYLFM
    YNRYKTP*
```

ORF138ng and ORF138-1 show 94.3% identity over 299aa overlap:

```
orf138-1.pep   MFRLQFRLFPPLRTAMHILLTALLKCLSLLPLSCLHTLGNRLGHLAFYLLKEDRARIVAN
               ||||||||||||||||||||||||||||||||| |||||||||||||||||||||||||
orf138ng       MFRLQFRLFPPLRTAMHILLTALLKCLSLLSLSCHTLGNRLGHLAFYLLKEDRARIVAN orf138-1.pep   MRQAGLNPDPKTVKAVFAETAKGGLELAPAFFRKPEDIETMFKAVHGWEHVQQALDKHEG
               |||||||||| : ||||||||||| ||||||||| |||||||||||||||||||||| ||
orf138ng       MRQAGLNPDTQTVKAVFAETAKCGLELAPAFFKKPEDIETMFKAVHGWEHVQQALDKGEG orf138-1.pep   LLFITPHIGSYDLGGRYISQQLPFPLTAMYKPPKIKAIDKIMQAGRVRGKGKTAPTSIQG
               ||||||||||||||||||||||||| |||||||||||||||||||||||||||||| |||
orf138ng       LLFITPHIGSYDLGGRYISQQLPFHLTAMYKPPKIKAIDKIMQAGRVRGKGKTAPTGIQG orf138-1.pep   VKQIIKALRSGEATIVLPDHVPSPQEGGGEGVWVDFFGKPAYTMTLAAKLAHVKGVKTLFF
               ||||||||| ||||| ||||||||||| | ||| ||||||||||||||||||||||||||
orf138ng       VKQIIKALRAGEATIILPDHVPSPQEGG-GVWADFFGKPAYTMTLAAKLAHVKGVKTLFF orf138-1.pep   CCERLPGGQGFDLHIRPVQGELNGDKAHDAAVFNRNAEYWIRRFPTQYLFMYNRYKMP
               ||||||| |||:|||||||||||||| ||||||||:|||||||||||||||||||| 
orf138ng       CCERLPDGQGFVLHIRPVQGELNGNKAHDAAVFNRNTEYWIRRFPTQYLFMYNRYKTP
```

In addition, ORF138ng is homologous to htrB protein from *Pseudomonas fluorescens*:

```
gnl|PID|e334283 (Y14568)  htrB [Pseudomonas fluorescens]  Length = 253
  Score = 80.8 bits (196), Expect = 9e-15
  Identities = 49/151 (32%), Positives = 79/151 (51%), Gaps = 6/151 (3%)

Query: 101  MFKAVHGWEHVQQALDKGEGLLFITPHIGSYD-LGGRYISQQLPFHLTAMYKPPKIYAID 159
            + + V G E +++AL  G+G++ IT H+G+++ L   Y SQ  P      Y+PPK+KA+D
Sbjct:  94  LVREVEGLEVLKEALASGKGVVGITSHLGNWEVLNHFYCSQCKPI---IFYRPPKLKAVD 150

Query: 160  KIMQAGRVRGKGKTAPTGIQGVKQIIKALRAGEATIILPDHVPSPQEGGGVWADFFGKPA 219
            ++++    RV+   K A +  +G+ +IK +R G     I  D  P P E  G++  FF  A
Sbjct: 151  ELLRKQRVQLGNKVAASTKEGILSVIKEVRKGGQVGIPAD--PEPAESAGIFVPFFATQA 208

Query: 220  YTMTLAAKLAHVKGVKTLFFCCERLPDGQGF                              250
              T      +          +F     RLPDG G+
Sbjct: 209  LTSKFVPNMLAGGKAVGVFLHALRLPDGSGY                              239
```

Based on this analysis, including the presence of a putative transmembrane domain in the gonococcal protein, it was predicted that the proteins from *N. meningitidis* and *N. gonorrhoeae*, and their epitopes, could be useful antigens for vaccines or diagnostics, or for raising antibodies.

ORF138-1 (57 kDa) was cloned in the pGex vectors and expressed in *E. coli*, as described above. The products of protein expression and purification were analyzed by SDS-PAGE. FIG. 14A shows the results of affinity purification of the GST-fusion protein. Purified GST-fusion protein was used to immunise mice, whose sera were used for ELISA (positive result) and FACS analysis (FIG. 14B). These experiments confirm that ORF138-1 is a surface-exposed protein, and that it is a useful immunogen.

Example 69

The following partial DNA sequence was identified in *N. meningitidis* <SEQ ID 573>:

```
  1  ...GCGTGGTCGG CCGGCGAATC GTGGCGTGTG TTAATGGAAA
        GTGAAACGTG
 51  GCATGCGGTG TGGAATACTT TGCGCTTCTC GGCGGCGGCG
        GTGTATGCGG
101  CAGCGGTTTT GGGTGTGGTG TATGCGGCGC CGGCGCGGCG
        GTCGGCGTGG
151  ATGCGCCGGC TGATGTTTTA GCCGTTTATG GTGTCGCCGG
        TTTGTGTTTC
201  GGCGGGCGTG CTGCTGCTTT ATCCGCAGTG GACGGCTTCG
        TTGCCGTTGC
251  TGCTGGCGAT GTATGCGCTG CTGGCGTATC CGTTTGTGGC
        AAAAGATGTT
301  TTATCAGCCT GGGATGCACT GCCGCCGGAT TACGGCAGGG
        CGGCGGCGGG
351  TTTGGGTGCA AACGGCTTTC AGACGGCATG CCGCATCACG
        TTCCCCCTCT
401  TGAAACCGGC GTTGCGGCGC GGTCTGACTT TGGCGGCGGC
        AACCTGCGTG
451  GGCGAATTTG CGGCGACATT GTTTCTGTCG CGTCCGGAAT
        GGCAGACGCT
501  GACGACTTTG ATTTATGCCT ATTTGGGACG CGCGGGTGAG
        GATAATTACG
551  CGCGGGCGAT GGTGCTG...
```

This corresponds to the amino acid sequence <SEQ ID 574; ORF139>:

```
  1 ..AWSAGESWRV LMESETWHAV WNTLRFSAAA VYAAAVLGVV YAAPARRSAW
 51   MRGLMFXPFM VSPVCVSAGV LLLYPQWTAS LPLLLAMYAL LAYPFVAKDV
101   LSAWDALPPD YGRAAAGLGA NGFQTACRIT FPLLKPALRR GLTLAAATCV
151   GEFAATLFLS RPEWQTLTTL IYAYLGRAGE DNYARAMVL..
```

Further work revealed the complete nucleotide sequence 10 <SEQ ID 575>:

```
   1 ATGGATGGAC GGCGTTGGGT GGTATGGGGT GCTTTTGCCC TGCTGCCTTC
  51 GGCTTTTTTG GCGGTAATGG TCGTTGCGCC TTTGTGGGCG GTGGCGGCGT
 101 ATGACGGTTT GGCGTGGCGC GCGGTGCTGT CGGATGCCTA TATGCTCAAA
 151 CGTTTGGCGT GGACGGTATT TCAGGCAGCG GCAACCTGTG TGCTGGTGCT
 201 GCCTTTGGGC GTGCCTGTCG CGTGGGTGCT GGCGCGGCTG GCGTTTCCGG
 251 GGCGGGCTTT GGTGCTGCGC CTGCTGATGC TGCCTTTTGT GATGCCCACG
 301 TTGGTGGCGG GCGTGGGCGT GCTGGCCCTG TTCGGGGCGG ACGGGCTGTT
 351 GTGGCGCGGC AGGCAGGATA CGCCGTATCT GTTGTTGTAC GGCAATGTGT
 401 TTTTCAACCT TCCTGTGTTG GTCAGGGCGG CGTATCAGGG GTTTGTGCAA
 451 GTGCCTGCGG CACGGCTTCA GACGGCACGG ACGTTGGGCG CGGGGGCGTG
 501 GCGGCGGTTT TGGGACATTG AAATGCCCGT TTTGCGCCCG TGGCTTGCCG
 551 GCGGCGTGTG CCTTGTCTTT CTGTATTGTT TTTCCGGGTT CGGGCTGGCG
 601 CTGCTGCTGG GCGGCAGCCG TTATGCCACG GTCGAAGTGG AAATTTACCA
 651 GTTGGTCATG TTCGAACTCG ATATGGCGGT TGCTTCGGTG CTGGTGTGGC
 701 TGGTGTTGGG GGTAACGGCG GCGGCAGGGT TGCTGTATGC GTGGTTCGGC
 751 AGGCGCGCGG TTTCGGATAA GGCGGTTTCC CCTGTGATGC CGTCGCCGCC
 801 GCAGTCGGTC GGGGAATATG TGCTGCTGGC GTTTGCGGCG GCGGTGTTGT
 851 CTGTGTGCTG CCTGTTTCCT TTGTTGGCAA TTGTTGTGAA AGCGTGGTCG
 901 GCCGGCGAAT CGTGGCGTGT GTTAATGGAA AGTGAAACGT GGCAGGCGGT
 951 GTGGAATACT TTGCGCTTCT CGGCGGCGGC GGTGTATGCG GCGGCGGTTT
1001 TGGGTGTGGT GTATGCGGCG GCGGCGCGGC GGTCGGCGTG GATGCGCGGG
1051 CTGATGTTTT TGCCGTTTAT GGTGTCGCCG GTTTGTGTTT CGGCGGGCGT
1101 GCTGCTGCTT TATCCGCAGT GGACGGCTTC GTTGCCGTTG CTGCTGGCGA
1151 TGTATGCGCT GCTGGCGTAT CCGTTTGTGG CAAAAGATGT TTTATCAGCC
1201 TGGGATGCAC TGCCGCCGGA TTACGGCAGG GCGGCGGCGG GTTTGGGTGC
1251 AAACGGCTTT CAGACGGCAT GCCGCATCAC GTTCCCCCTC TTGAAACCGG
1301 CGTTGCGGCG CGGTCTGACT TTGGCGGCGG CAACCTGCGT GGGCGAATTT
1351 GCGGCGACAT TGTTTCTGTC GCGTCCGGAA TGGCAGACGC TGACGACTTT
1401 GATTTATGCC TATTTGGGAC GCGCGGGTGA GGATAATTAC GCGCGGGCGA
1451 TGGTGCTGAC ATTGCTGTTG GCGGCGTTCG CGCTGGGTAT TTTCCTGCTG
1501 TTGGACGGCG GCGAAGGCGG AAAACAGACG GAAACGTTAT AA
```

This corresponds to the amino acid sequence <SEQ ID 576; ORF139-1>:

```
  1 MDGRRWVVWG AFALLPSAFL AVMVVAPLWA VAAYDGLAWR AVLSDAYMLK

51 RLAWTVFQAA ATCVLVLPLG VPVAWVLARL AFPGRALVLR LLMLPFVMPT

101 LVAGVGVLAL FGADGLLWRG RQDTPYLLLY GNVFFNLPVL VRAAYQGFVQ

151 VPAARLQTAR TLGAGAWRRF WDIEMPVLRP WLAGGVCLVF LYCFSGFGLA

201 LLLGGSRYAT VEVEIYQLVM FELDMAVASV LVWLVLGVTA AAGLLYAWFG

251 RRAVSDKAVS PVMPSPPQSV GEYVLLAFAA AVLSVCCLFP LLAIVVKAWS

301 AGESWRVLME SETWQAVWNT LRFSAAAVYA AAVLGVVYAA AARRSAWMRG

351 LMFLPFMVSP VCVSAGVLLL YPQWTASLPL LLAMYALLAY PFVAKDVLSA

401 WDALPPDYGR AAAGLGANGF QTACRITFPL LKPALRRGLT LAAATCVGEF

451 AATLFLSRPE WQTLTTLIYA YLGRAGEDNY ARAMVLTLLL AAFALGIFLL

501 LDGGEGGKQT ETL*
```

Computer analysis of this amino acid sequence gave the following results:

Homology with a Predicted ORF from *N. meningitidis* (Strain A)

ORF139 shows 94.7% identity over a 189aa overlap with an ORF (ORF139a) from strain A of *N. meningitidis*:

```
                             10        20        30
orf139.pep                   AWSAGESWRVLMESETWHAVWNTLRFSAAA
                             ||||||||||||||| :|||||||||||
orf139a    QSVGEYVLLAFAAAVXSVCCLFXLLAIVVKAWSAGESWRVLMESETWQAVWNTXRFSAAA
           270       280       290       300       310       320
                     40        50        60        70        80        90
orf139.pep VYAAAVLGVVYAAPARRSAWMRGLMFXPFMVSPVCVSAGVLLLYPQWTASLPLLLAMYAL
           ||||||||||||| ||||||||||||| ||||||||||||||| ||||||||||||||||
orf139a    VYAAVLGVVYAAAAARRSAWMRGLMFLPFMVSPVCVSAGVLLLXPQWTASLPLLLAMYAL
           330       340       350       360       370       380
                     100       110       120       130       140       150
orf139.pep LAYPFVAKDVLSAWDALPPDYGRAAAGLGANGFQTACRITFPLLKPALRRGLTLAAATCV
           ||||||||||||| ||||||||||||||||||||||||||||||||||||||||||||||
orf139a    LAYPFVAKDVLSAXDALPPDYGRAAAGLGANGFQTACRITFPLLKPALRRGLTLAAATCV
           390       400       410       420       430       440
                     160       170       180   189
orf139.pep GEFAATLFLSRPEWQTLTTLIYAYLGRAGEDNYARAMVL
           |||||||| || |||||||||||| |||| |||||||||
orf139a    GEFAATLFXSRXEWQTLTTLIYAYXGRAGXDNYARAMVLTLLLAAFALGXFLLLDGGEGG
           450       460       470       480       490       500
```

The complete length ORF139a nucleotide sequence <SEQ ID 577> is:

```
  1 ATGGATGGAC GGCGTTGGGC GGTATGGGGT GCTTTTGCCC TGCTGCCTTC

51 GGCTTTTTTG GCGGCAATGG TCGTTGCGCC TTTGTGGGCG GTGGCGGCGT

101 ATGACGGTTT GGCGTGGCGC GCGGTGCTGT CGGATGCCTA TATGCTCAAA

151 CGTTTGGCGT GGACGGTATT TCAGGCAGCG GCAACCTGTG TGCTGGTGCT

201 GCCTTTGGGC GTGCCTGTCG CGTGGGTGCT GGCGCGGCTG GCGTTTCCGG

251 GGCGGGCTTT GGTGCTGCGC CTGCTGATGC TGCCTTTTGT GATGCCCACG

301 TTGGTGGCGG GCGTGGGCGT GCTGGCTCTG TTCGGGGCGG ACGGCCTGTN

351 GTGGCGCGGC TGGCAGGATA CGCCGTATCT GTTGTTGTAC GGCAATGTGT
```

```
 401 TTTTTNACCT TCCTGTGTTG GTCAGGGCGG CATATCAGGG GTTTGTGCAA

451 GTGCCTGCGG CACGGCTTCA GACGGCACNG ACATTGGGCG CGGGGGCGTG

501 GCGGCGGTTT TGGGACATTG AAATGCCCGT TTTGCGCCCG TGGCTTGCCG

551 GCGGCGTGTG CCTTGTCTTC CTGTATTGTT TTTCGGGGTT CGGGCTGGCA

601 TTGCTGCTGG GCGGCAGCCG TTATGCCACG GTCGAAGTGG AAATTTACCA

651 GTTGGTCATG TTCGAACTCG ATATGGCGGT TGCTTCGGTG CTNGTGTGGC

701 TGGTGTNGGG GGTAACNGCG GCGGCAGGGT TGCTGTATGC GTGGTTCGGC

751 AGGCGCGCGG TTTCGGATAA GGCNGTTTCC CCTGTGATGC CGTCGCCGCC

801 GCAGTCGGTC GGGGAATATG TGCTNCTGGC GTTTGCGGCG GCGGTGTNGT

851 CTGTGTGCTG CCTGTTTCNT TTGTTGGCAA TTGTTGTGAA AGCGTGGTCG

901 GCCGGCGAAT CGTGGCGTGT GTTAATGGAA AGTGAAACGT GGCAGGCGGT

951 GTGGAATACT NTGCGCTTCT CGGCGGCGGC GGTGTATGCG GCGGCGGTTT

1001 TGGGTGTGGT GTATGCGGCG GCGGCGCGGC GGTCGGCGTG GATGCGCGGG

1051 CTGATGTTTT TGCCGTTTAT GGTGTCGCCG GTTTGTGTTT CGGCGGGCGT

1101 GCTGCTGCTT NATCCGCAGT GGACGGCTTC GTTGCCGCTG CTGCTGGCGA

1151 TGTATGCGCT GCTGGCGTAT CCGTTTGTGG CAAAAGATGT TTTATCAGCC

1201 TGNGATGCAC TGCCGCCGGA TTACGGCAGG GCGGCGGCGG GTTTGGGTGC

1251 AAACGGCTTT CAGACGGCAT GCCGCATCAC GTTCCCCCTC TTGAAACCGG

1301 CGTTGCGGCG CGGTCTGACT TTGGCGGCGG CAACCTGCGT GGGCGAATTT

1351 GCGGCAACCT TGTTCNTGTC GCGTCNCGAG TGGCAGACGC TGACGACTTT

1401 GATTTATGCC TATNTGGGAC GCGCGGGTGA NGATAATTAC GCGCGGGCGA

1451 TGGTGCTGAC ATTGCTGTTG GCGGCGTTCG CGCTGGGTAT NTTCCTGCTG

1501 TTGGACGGCG GCGAAGGCGG AAAACGGACG GAAACGTTAT AA
```

This encodes a protein having amino acid sequence <SEQ ID 578>:

```
  1 MDGRRWAVWG AFALLPSAFL AAMVVAPLWA VAAYDGLAWR AVLSDAYMLK

51 RLAWTVFQAA ATCVLVLPLG VPVAWVLARL AFPGRALVLR LLMLPFVMPT

101 LVAGVGVLAL FGADGLXWRG WQDTPYLLLY GNVFFXLPVL VRAAYQGFVQ

151 VPAARLQTAX TLGAGAWRRF WDIEMPVLRP WLAGGVCLVF LYCFSGFGLA

201 LLLGGSRYAT VEVEIYQLVM FELDMAVASV LVWLVXGVTA AAGLLYAWFG

251 RRAVSDKAVS PVMPSPPQSV GEYVLLAFAA AVXSVCCLFX LLAIVVKAWS

301 AGESWRVLME SETWQAVWNT XRFSAAAVYA AAVLGVVYAA AARRSAWMRG

351 LMFLPFMVSP VCVSAGVLLL XPQWTASLPL LLAMYALLAY PFVAKDVLSA

401 XDALPPDYGR AAAGLGANGF QTACRITFPL LKPALRRGLT LAAATCVGEF

451 AATLFXSRXE WQTLTTLIYA YXGRAGXDNY ARAMVLTLLL AAFALGXFLL

501 LDGGEGGKRT ETL*
```

ORF139a and ORF139-1 show 96.5% homology over a 514aa overlap:

```
orf139a.pep    MDGRRWAVWGAFALLPSAFLAAMVVAPLWAVAAYDGLAWRAVLSDAYMLKRLAWTVFQAA
               ||||||:|||||||||||||:|||||||||||||||||||||||||||||||||||||||
orf139-1       MDGRRWVVWGAFALLPSAFLAVMVVAPLWAVAAYDGLAWRAVLSDAYMLKRLAWTVFQAA orf139a.pep    ATCVLVLPLGVPVAWVLARLAFPGRALVLRLLMLPFVMPTLVAGVGVLALFGADGLXWRG
               ||||||||||||||||||||||||||||||||||||||||||||||||||||||||| ||
orf139-1       ATCVLVLPLGVPVAWVLARLAFPGRALVLRLLMLPFVMPTLVAGVGVLALFGADGLLWRG orf139a.pep    WQDTPYLLLYGNVFFXLPVLVRAAYQGFVQVPAARLQTAXTLGAGAWRRFWDIEMPVLRP
               :|||||||||||||| |||||||||||||||||||||| |||||||||||||||||||||
orf139-1       RQDTPYLLLYGNVFFNLPVLVRAAYQGFVQVPAARLQTARTLGAGAWRRFWDIEMPVLRP orf139a.pep    WLAGGVCLVFLYCFSGFGLALLLGGSRYATVEVEIYQLVMFELDMAVASVLVWLVXGVTA
               ||||||||||||||||||||||||||||||||||||||||||||||||||||||| ||||
orf139-1       WLAGGVCLVFLYCFSGFGLALLLGGSRYATVEVEIYQLVMFELDMAVASVLVWLVLGVTA orf139a.pep    AAGLLYAWFGRRAVSDKAVSPVMPSPPQSVGEYVLLAFAAAVXSVCCLFXLLAIVVKAWS
               |||||||||||||||||||||||||||||||||||||||||| ||||||| |||||||||
orf139-1       AAGLLYAWFGRRAVSDKAVSPVMPSPPQSVGEYVLLAFAAAVLSVCCLFPLLAIVVKAWS orf139a.pep    AGESWRVLMESETWQAVWNTXRFSAAAVYAAAVLGVVYAAAARRSAWMRGLMFLPFMVSP
               |||||||||||||||||||| |||||||||||||||||||||||||||||||||||||||
orf139-1       AGESWRVLMESETWQAVWNTLRFSAAAVYAAAVLGVVYAAAARRSAWMRGLMFLPFMVSP orf139a.pep    VCVSAGVLLLXPQWTASLPLLLAMYALLAYPFVAKDVLSAXDALPPDYGRAAAGLGANGF
               |||||||||| |||||||||||||||||||||||||||| ||||||||||||||||||||
orf139-1       VCVSAGVLLLYPQWTASLPLLLAMYALLAYPFVAKDVLSAWDALPPDYGRAAAGLGANGF orf139a.pep    QTACRITFPLLKPALRRGLTLAAATCVGEFAATLFXSRXEWQTLTTLIYAYXGRAGXDNY
               |||||||||||||||||||||||||||||||||||| || |||||||||||| |||| ||
orf139-1       QTACRITFPLLKPALRRGLTLAAATCVGEFAATLFLSRPEWQTLTTLIYAYLGRAGEDNY orf139a.pep    ARAMVLTLLLAAFALGXFLLLDGGEGGKRTETLX
               |||||||||||||||| ||||||||||:|||||
orf13-1        ARAMVLTLLLAAFALGIFLLLDGGEGGKQTETLX
```

Homology with a Predicted ORF from *N. gonorrhoeae*

ORF139 shows 95.2% identity over a 189aa overlap with a predicted ORF (ORF139ng) from *N. gonorrhoeae*:

```
orf139.pep                                   AWSAGESWRVLMESETWHAVWNTLRFSAAA    30
                                             ||||||||||||||||||:|||||||||||
orf139ng       QSVGEYVLLAFSVAVLSVCCLFPLSAIVVKAWSAGESRRVLMESETWQAVWNTLRFSAAA   327 orf139.pep     VYAAAVLGVVYAAPARRSAWMRGLMFXPFMVSPVCVSAGVLLLYPQWTASLPLLLAMYAL    90
               |:||||||||||:||||| ||:||||| |||||||||||||||| |||||||||||||||
orf139ng       VFAAAVLGVVYAAAARRLVWMRGLVFLPFMVSPVCVSAGVLLLYPGWTASLPLLLAMYAL   387 orf139.pep     LAYPFVAKDVLSAWDALPPDYGRAAAGLGANGFQTACRITFPLLKPALRRGLTLAAATCV   150
               ||||||||||||||||||||||||||||||||||||||||||||||||||||||||||||
orf139ng       LAYPFVAKDVLSAWDALPPDYGRAAAGLGANGFQTACRITFPLLKPALRRGLTLAAATCV   447 orf139.pep     GEFAATLFLSRPEWQTLTTLIYAYLGRAGEDNYARAMVL                       189
               |||||||||||||||||||||||||||||||||||||||
orf139ng       GEFAATLFLSRPEWQTLTTLIYAYLGRAGEDNYARAMVLTLLLSAFAVCIFLLLDNGEGG   507
```

The complete length ORF139ng nucleotide sequence <SEQ ID 579> is predicted to encode a protein having amino acid sequence <SEQ ID 580>:

```
  1  MDGRCWAVRG  AFSLLPSAFL  AVMVVAPLWA  VAAYDGLAWR  AVLSDAYMLK

51  RLAWTVFQAA  ATCVLVLPLG  VPVAWVLARL  AFPGRALVLR  LLMLPFVMPT

101  LVAGVGVLAL  FGADGLLWRG  RQDTPYLLLY  GNVFFNLPVL  VRAAYQGFAQ

151  VPAARLQTAR  TLGAGAWRPF  WDIEMPVLRP  WLAGGVCLVF  LYCFSGFGLA

201  LLLGGSRYAT  VEVEIYQLVM  FELDMAGASA  LVWLVLGVTA  AAGLLYAWFG

251  RRAVSDKAVS  PVMPSPPQSV  GEYVLLAFSV  AVLSVCCLFP  LSAIVVKAWS

301  AGESRRVLME  SETWQAVWNT  LRFSAAAVFA  AAVLGVVYAA  AARRLVWMRG

351  LVFLPFMVSP  VCVSAGVLLL  YPGWTASLPL  LLAMYALLAY  PFVAKDVLSA

401  WDALPPDYGR  AAAGLGANGF  QTACRITFPL  LKPALRRGLT  LAAATCVGEF
```

```
-continued
451 AATLFLSRPE WQTLTTLIYA YLGRAGEDNY ARAMVLTLLL SAFAVCIFLL

501 LDNGEGGKRT ETL*
```

Further work revealed a variant gonococcal DNA sequence
<SEQ ID 581>:

```
   1 ATGGATGGAC GGTGTTGGGC GGTACGGGGT GCTTTTTCCC TGCTGCCTTC

51 GGCTTTTTTG GCGGTAATGG TCGTTGCGCC TTTGTGGGCG GTGGCGGCGT

101 ATGACGGTTT GGCGTGGCGC GCGGTGCTGT CGGATGCCTA TATGCTCAAA

151 CGTTTGGCGT GGACGGTGTT TCAGGCGGCG GCAACCTGTG TGCTGGTGCT

201 GCCTTTGGGC GTGCCTGTCG CGTGGGTGCT GGCGCGGCTG GCGTTCCCGG

251 GGCGGGCTTT GGTGCTGCGC CTGCTGATGC TGCCGTTTGT GATGCCCACG

301 CTGGTGGCGG GCGTGGGCGT GCTGGCTCTG TTCGGGGCGG ACGGGCTGTT

351 GTGGCGCGGC CGGCAGGATA CGCCGTATCT GTTGTTGTAC GGCAATGTGT

401 TTTTCAACCT GCCCGTGTTG GTCAGGGCGG CGTATCAGGG GTTTGCTCAA

451 GTGCCTGCGG CACGGCTTCA GACGGCACGG ACGTTGGGCG CGGGGGCGTG

501 GCGGCGGTTT TGGGACATTG AAATGCCCGT TTTGCGCCCG TGGCTTGCCG

551 GCGGCGTGTG CCTTGTCTTC CTGTATTGTT TTTCGGGGTT CGGGCTGGCA

601 TTGCTGTTGG GCGGCAGCCG TTATGCCACG GTCGAAGTGG AAATTTACCA

651 GTTGGTTATG TTCGAACTCG ATATGGCGGG GGCTTCGGCG CTGGTGTGGC

701 TGGTGTTGGG GGTAACGGCG GCGGCAGGGT TGCTGTATGC GTGGTTCGGC

751 AGGCGCGCGG TTTCGGATAA GGCGGTTTCC CCCGTGATGC CGTCGCCGCC

801 GCAATCGGTG GGGGAATATG TATTGCTGGC ATTTTCGGTG GCGGTGTTGT

851 CCGTGTGCTG CCTGTTTCCT TGTCGGCAA TTGTTGTGAA AGCGTGGTCG

901 GCCGGCGAAT CGCGGCGTGT GTTAATGGAA AGTGAAACGT GGCAGGCAGT

951 GTGGAATACt ttGCGCTTTT CGGCGGCGGC GGTGTTTGCG GCGGCGGTTT

1001 TGGGTGTGGT GTATGCGGCG GCGGCGCGGC GGCTGGTGTG GATGCGCGGA

1051 CTGGTGTTTT TACCGTTTAT GGTGTCGCCG GTTTGTGTTT CGGCGGGCGT

1101 GCTGCTGCTT TATCCGGGGT GGACGGCTTC GTTACCGCTG CTGCTGGCGA

1151 TGTATGCGCT GCTGGCGTAT CCGTTTGTGG CAAAAGATGT TTTATCGGCC

1201 TGGGATGCAC TGCCGCCGGA TTACGGCAGG GCGGCGGCAG GTTGGGCGC

1251 AAACGGCTTT CAGACGGCAT GCCGTATCAC GTTCCCCCTC TTGAAACCGG

1301 CGTTGCGGCG CGGTCTGACT TTGGCGGCGG CGACGTGTGT GGGCGAATTT

1351 GCGGCAACCT TGTTCCTGTC GCGTCCGGAA TGGCAGACGT TGACGACTTT

1401 GATTTATGCC TATTTGGGGC GTGCGGGTGA GGACAATTAT GCGCGGGCAA

1451 TGGTGTTGAC ATTGCTGTTG TCGGCATTTG CGGTGTGCAT TTTCCTGCTG

1501 TTGGACAACG GCGAAGGCGg aaaACGGACG GAAACGTTAT AA
```

This corresponds to the amino acid sequence <SEQ ID 582; ORF139ng-1>:

```
  1 MDGRCWAVRG AFSLLPSAFL AVMVVAPLWA VAAYDGLAWR AVLSDAYMLK

51 RLAWTVFQAA ATCVLVLPLG VPVAWVLARL AFPGRALVLR LLMLPFVMPT

101 LVAGVGVLAL FGADGLLWRG RQDTPYLLLY GNVFFNLPVL VRAAYQGFAQ

151 VPAARLQTAR TLGAGAWRRF WDIEMPVLRP WLAGGVCLVF LYCFSGFGLA

201 LLLGGSRYAT VEVEIYQLVM FELDMAGASA LVWLVLGVTA AAGLLYAWFG

251 RRAVSDKAVS PVMPSPPQSV GEYVLLAFSV AVLSVCCLFP LSAIVVKAWS

301 AGESRRVLME SETWQAVWNT LRFSAAAVFA AAVLGVVYAA AARRLVWMRG

351 LVFLPFMVSP VCVSAGVLLL YPGWTASLPL LLAMYALLAY PFVAKDVLSA

401 WDALPPDYGR AAAGLGANGF QTACRITFPL LKPALRRGLT LAAATCVGEF

451 AATLFLSRPE WQTLTTLIYA YLGRAGEDNY ARAMVLTLLL SAFAVCIFLL

501 LDNGEGGKRT ETL*
```

ORF139ng-1 and ORF139-1 show 95.9% identity over 513aa overlap:

```
orf139ng    MDGRCWAVRGAFSLLPSAFLAVMVVAPLWAVAAYDGLAWRAVLSDAYMLKRLAWTVFQAA
            ||||  | :|   |||:|||||||||||||||||||||||||||||||||||||||||||
orf139-1    MDGRRWVVWGAFALLPSAFLAVMVVAPLWAVAAYDGLAWRAVLSDAYMLKRLAWTVFQAA orf139ng    ATCVLVLPLGVPVAWVLARLAFPGRALVLRLLMLPFVMPTLVAGVGVLALFGADGLLWRG
            ||||||||||||||||||||||||||||||||||||||||||||||||||||||||||||
orf139-1    ATCVLVLPLGVPVAWVLARLAFPGRALVLRLLMLPFVMPTLVAGVGVLALFGADGLLWRG orf139ng    RQDTPYLLLYGNVFFNLPVLVRAAYQGFAQVPAARLQTARTLGAGAWRRFWDIEMPVLRP
            |||||||||||||||||||||||||||||:|||||||||||||||||||||||||||||
orf139-1    RQDTPYLLLYGNVFFNLPVLVRAAYQGFVQVPAARLQTARTLGAGAWRRFWDIEMPVLRP orf139ng    WLAGGVCLVFLYCFSGFGLALLLGGSRYATVEVEIYQLVMFELDMAGASALVWLVLGVTA
            |||||||||||||||||||||||||||||||||||||||||||||:|||||||||||||
orf139-1    WLAGGVCLVFLYCFSGFGLALLLGGSRYATVEVEIYQLVMFELDMAVASVLVWLVLGVTA orf139ng    AAGLLYAWFGRRAVSDKAVSPVMPSPPQSVGEYVLLAFSVAVLSVCCLFPLSAIVVKAWS
            ||||||||||||||||||||||||||||||||||||||::|||||||||| |||||||||
orf139-1    AAGLLYAWFGRRAVSDKAVSPVMPSPPQSVGEYVLLAFAAAVLSVCCLFPLLAIVVKAWS orf139ng    AGESRRVLMESETWQAVWNTLRFSAAAVFAAAVLGVVYAAAARRLVWMRGLVFLPFMVSP
            ||||  ||||||||||||||||||||||:|||||||||||||||: ||||:|||:|||||
orf139      AGESWRVLMESETWQAVWNTLRFSAAAVYAAAVLGVVYAAAARRSAWMRGLMFLPFMVSP orf139ng    VCVSAGVLLLYPGWTASLPLLLAMYALLAYPFVAKDVLSAWDALPPDYGRAAAGLGANGF
            ||||||||||||| ||||||||||||||||||||||||||||||||||||||||||||||
orf139-1    VCVSAGVLLLYPQWTASLPLLLAMYALLAYPFVAKDVLSAWDALPPDYGRAAAGLGANGF orf139ng    QTACRITFPLLKPALRRGLTLAAATCVGEFAATLFLSRPEWQTLTTLIYAYLGRAGEDNY
            ||||||||||||||||||||||||||||||||||||||||||||||||||||||||||||
orf139-1    QTACRITFPLLKPALRRGLTLAAATCVGEFAATLFLSRPEWQTLTTLIYAYLGRAGEDNY orf139ng    ARAMVLTLLLSAFAVCIFLLLDNGEGGKRTETL
            ||||||||||:|||: |||||||:|||||:|||
orf139-1    ARAMVLTLLLAAFALGIFLLLDGGEGGKQTETL
```

Based on the presence of a predicted binding-protein-dependent transport systems inner membrane component signature (underlined) in the gonococcal protein, it is predicted that the proteins from *N. meningitidis* and *N. gonorrhoeae*, and their epitopes, could be useful antigens for vaccines or diagnostics, or for raising antibodies.

Example 70

The following partial DNA sequence was identified in *N. meningitidis* <SEQ ID 583>:

```
  1 ATGGACGCCT GGACACAGAC GCTGTCCGCG CAAACCCTGT TGGGCATTTC

51 GGCGGCGGCA ATCATCCTCA TTCTGATTTT AATCGTCAGA TTCCGCATCC

101 ACGCGCTGCT GACACTGGTC ATCGTCAGCC TGCTGACGGC TTTGGCAACC

151 GGTTTGCCCA CAGGCAGCAT TGTCAAAGAC ATACTGGTCA AAAACTTCGG

201 CGGCACGCTC GGCGGCGTGG CGCTTCTGGT CGGCCTGGGC GCGATGCTCG

251 AACGTTTGGT C...
```

This corresponds to the amino acid sequence <SEQ ID 584; ORF140>:

```
  1 MDGWTQTLSA QTLLGISAAA IILILILIVR FRIHALLTLV IVSLLTALAT

51 GLPTGSIVKD ILVKNFGGTL GGVALLVGLG AMLERLV..
```

Further work revealed the complete nucleotide sequence <SEQ ID 585>:

```
  1 ATGGACGGCT GGACACAGAC GCTGTCCGCG CAAACCCTGT TGGGCATTTC

51 GGCGGCGGCA ATCATCCTCA TTCTGATTTT AATCGTCAAA TTCCGCATCC

101 ACGCGCTGCT GACACTGGTC ATCGTCAGCC TGCTGACGGC TTTGGCAACC

151 GGTTTGCCCA CAGGCAGCAT TGTCAACGAC ATACTGGTCA AAAACTTCGG

201 CGGCACGCTC GGCGGCGTGG CGCTTCTGGT CGGCCTGGGC GCGATGCTCG

251 GACGTTTGGT CGAAACATCC GGCGGCGCAC AGTCGCTGGC GGACGCGCTG

301 ATCCGGATGT TCGGCGAAAA ACGCGCACCG TTCGCGCTCG GCGTTGCCTC

351 GCTGATTTTC GGCTTCCCGA TTTTCTTCGA TGCCGGACTA ATCGTCATGC

401 TGCCCATCGT GTTCGCCACC GCACGGCGCA TGAAACAGGA CGTACTGCCC

451 TTCGCGCTTG CCTCCATCGG CGCATTTTCC GTCATGCACG TCTTCCTGCC

501 GCCCCATCCG GGCCCGATTG CCGCTTCCGA ATTTTACGGC GCGAACATCG

551 GCCAAGTTTT GATTTGGGT CTGCCGACCG CCTTCATCAC ATGGTATTTC

601 AGCGGCTATA TGCTCGGCAA AGTGTTGGGG CGCACCATCC ATGTTCCCGT

651 TCCCGAACTG CTCAGCGGCG GCACGCAAGA CAACGACCTG CCGAAAGAAC

701 CTGCCAAAGC AGGAACGGTC GTCGCCATCA TGCTGATTCC CATGCTGCTG

751 ATTTTCCTGA ATACCGGCGT ATCGGCCCTC ATCAGCGAAA AACTCGTAAG

801 TGCGGACGAA ACCTGGGTTC AGACGGCAAA AATAATCGGT TCGACACCGA

851 TCGCCCTTCT GATTTCCGTA TTGGTCGCAC TGTTTGTCTT GGGACGCAAA
```

```
                    -continued
 901 CGCGGCGAAA GCGGCAGCGC GTTGGAAAAA ACCGTGGACG GCGCACTCGC

951 CCCCGTCTGT TCCGTGATTC TGATTACCGG CGCGGGCGGT ATGTTCGGCG

1001 GCGTTTTGCG CGCTTCCGGC ATCGGCAAGG CACTCGCCGA CAGCATGGCG

1051 GATTTGGGCA TTCCCGTCCT TTTGGGCTGT TTCCTTGTCG CCTTGGCACT

1101 GCGTATCGCG CAAGGTTCGG CAACCGTCGC CCTGACCACC GCCGCCGCGC

1151 TGATGGCTCC TGCCGTTGCC GCCGCCGGCT TTACCGACTG GCAGCTCGCC

1201 TGTATCGTAT TGGCAACGGC GGCAGGTTCG GTCGGTTGCA GCCACTTCAA

1251 CGACTCCGGC TTCTGGCTGG TCGGCCGTCT CTTGGACATG GACGTACCGA

1301 CCACGCTGAA AACCTGGACG GTCAACCAAA CCCTCATCGC ACTCATCGGC

1351 TTTGCCTTGT CCGCACTGCT GTTCGCCATC GTCTGA
```

This corresponds to the amino acid sequence <SEQ ID 586; ORF140-1>:

```
  1 MDGWTQTLSA QTLLGISAAA IILILILIVK FRIHALLTLV IVSLLTALAT

51 GLPTGSIVND ILVKNFGGTL GGVALLVGLG AMLGRLVETS GGAQSLADAL

101 IRMFGEKRAP FALGVASLIF GFPIFFDAGL IVMLPIVFAT ARRMKQDVLP

151 FALASIGAFS VMHVFLPPHP GPIAASEFYG ANIGQVLILG LPTAFITWYF

201 SGYMLGKVLG RTIHVPVPEL LSGGTQDNDL PKEPAKAGTV VAIMLIPMLL

251 IFLNTGVSAL ISEKLVSADE TWVQTAKIIG STPIALLISV LVALFVLGRK

301 RGESGSALEK TVDGALAPVC SVILITGAGG MFGGVLRASG IGKALADSMA

351 DLGIPVLLGC FLVALALRIA QGSATVALTT AAALMAPAVA AAGFTDWQLA

401 CIVLATAAGS VGCSHFNDSG FWLVGRLLDM DVPTTLKTWT VNQTLIALIG

451 FALSALLFAI V*
```

Computer analysis of this amino acid sequence gave the following results:

Homology with a Predicted ORF from *N. meningitidis* (Strain A)

ORF140 shows 95.4% identity over a 87aa overlap with an ORF (ORF140a) from strain A of *N. meningitidis*:

```
                    10         20         30         40         50         60
orf140.pep   MDGWTQTLSAQTLLGISAAAIILILILIVRFRIHALLTLVIVSLLTALATGLPTGSIVKD
             ||||||||||||||||||||||||||||:|||||||||||||||||||||||||||||:|
orf140a      MDGWTQTLSAQTLLGISAAAIILILILIVKFRIHALLTLVIVSLLTALATGLPTGSIVND
                    10         20         30         40         50         60

70         80
orf140.pep   ILVKNFGGTLGGVALLVGLGAMLERLV
             :||||||||||||||||||||||:|||
orf140a      VLVKNFGGTLGGVALLVGLGAMLGRLVETSGGAQSLADALIRMFGEKRAPFALGVASLIF
                    70         80         90        100        110        120
```

The complete length ORF140a nucleotide sequence <SEQ ID 587> is:

```
   1 ATGGACGGCT GGACACAGAC GCTGTCCGCG CAAACCCTGT TGGGCATTTC
  51 GGCGGCGGCA ATCATCCTCA TTCTGATTTT AATCGTCAAA TTCCGCATCC
 101 ACGCGCTGCT GACACTGGTC ATCGTCAGCC TGCTGACGGC TTTGGCAACC
 151 GGTTTGCCCA CAGGCAGCAT TGTCAACGAC GTACTGGTCA AAAACTTCGG
 201 CGGCACGCTC GGCGGCGTGG CGCTTCTGGT CGGCCTGGGC GCGATGCTCG
 251 GACGTTTGGT CGAAACATCC GGCGGCGCAC AGTCGCTGGC GGACGCGCTG
 301 ATCCGGATGT TCGGCGAAAA ACGCGCACCG TTCGCGCTGG CGTTGCCTC
 351 GCTGATTTTC GGCTTCCCGA TTTTCTTCGA TGCCGGACTA ATCGTCATGC
 401 TGCCCATCGT GTTCGCCACC GCACGGCGCA TGAAACAGGA CGTACTGCCC
 451 TTCGCGCTTG CCTCCATCGG CGCATTTTCC GTCATGCACG TCTTCCTGCC
 501 GCCCCATCCG GGCCCGATTG CCGCTTCCGA ATTTTACGGC GCGAACATCG
 551 GCCAAGTTTT GATTTTGGGT CTGCCGACCG CCTTCATCAC ATGGTATTTC
 601 AGCGGCTATA TGCTCGGCAA AGTGTTGGGG CGCACCATCC ATGTTCCCGT
 651 TCCCGAACTG CTCAGCGGCG GCACGCAAGA CAACGACCTG CCGAAAGAAC
 701 CTGCCAAAGC AGGAACGGTC GTCGCCATCA TGCTGATTCC CATGCTGCTG
 751 ATTTTCCTGA ATACCGGCGT ATCGGCCCTC ATCAGCGAAA AACTCGTAAG
 801 TGCCGACGAA ACCTGGGTTC AGACGGCAAA AATAATCGGT TCGACACCGA
 851 TCGCCCTTCT GATTTCCGTA TTGGTCGCAC TGTTTGTCTT GGGACGCAAA
 901 CGCGGCGAAA GCGGCAGCGC GTTGGAAAAA ACCGTGGACG GCGCACTCGC
 951 CCCCGTCTGT TCCGTGATTC TGATTACCGG CGCGGGCGGT ATGTTCGGCG
1001 GCGTTTTGCG CGCTTCCGGC ATCGGCAAGG CACTCGCCGA CAGCATGGCG
1051 GATTTGGGCA TTCCCGTCCT TTTGGGCTGT TTCCTTGTCG CCTTGGCACT
1101 GCGTATCGCG CAAGGTTCGG CAACCGTCGC CCTGACCACC GCCGCCGCGC
1151 TGATGGCTCC TGCCGTTGCC GCCGCCGGCT TTACCGACTG GCAGCTCGCC
1201 TGTATCGTAT TGGCAACGGC GGCAGGTTCG GTCGGTTGCA GCCACTTCAA
1251 CGACTCCGGC TTCTGGCTGG TCGGCCGCCT CTTGGACATG GACGTACCGA
1301 CCACGCTGAA AACCTGGACG GTCAACCAAA CCCTCATCGC ACTCATCGGC
1351 TTTGCCTTGT CCGCACTGCT GTTCGCCATC GTCTGA
```

This encodes a protein having amino acid sequence <SEQ ID 588>:

```
  1 MDGWTQTLSA QTLLGISAAA IILILILIVK FRIHALLTLV IVSLLTALAT
 51 GLPTGSIVND VLVKNFGGTL GGVALLVGLG AMLGRLVETS GGAQSLADAL
101 IRMFGEKRAP FALGVASLIF GFPIFFDAGL IVMLPIVFAT ARRMKQDVLP
151 FALASIGAFS VMHVFLPPHP GPIAASEFYG ANIGQVLILG LPTAFITWYF
201 SGYMLGKVLG RTIHVPVPEL LSGGTQDNDL PKEPAKAGTV VAIMLIPMLL
251 IFLNTGVSAL ISEKLVSADE TWVQTAKIIG STPIALLISV LVALFVLGRK
301 RGESGSALEK TVDGALAPVC SVILITGAGG MFGGVLRASG IGKALADSMA
```

```
-continued
351 DLGIPVLLGC FLVALALRIA QGSATVALTT AAALMAPAVA AAGFTDWQLA

401 CIVLATAAGS VGCSHFNDSG FWLVGRLLDM DVPTTLKTWT VNQTLIALIG

451 FALSALLFAI V*
```

ORF140a and ORF140-1 show 99.8% identity over a 461aa overlap:

```
orf140-1.pep    MDGWTQTLSAQTLLGISAAAIILILILIVKFRIHALLTLVIVSLLTALATGLPTGSIVND    60
                ||||||||||||||||||||||||||||||||||||||||||||||||||||||||||||
orf140a         MDGWTQTLSAQTLLGISAAAIILILILIVKFRIHALLTLVIVSLLTALATGLPTGSIVND    60 orf140-1.pep    ILVKNFGGTLGGVALLVGLGAMLGRLVETSGGAQSLADALIRMFGEKRAPFALGVASLIF   120
                :|||||||||||||||||||||||||||||||||||||||||||||||||||||||||||
orf140a         VLVKNFGGTLGGVALLVGLGAMLGRLVETSGGAQSLADALIRMFGEKRAPFALGVASLIF   120 orf140-1.pep    GFPIFFDAGLIVMLPIVFATARRMKQDVLPFALASIGAFSVMHVFLPPHPGPIAASEFYG   180
                ||||||||||||||||||||||||||||||||||||||||||||||||||||||||||||
orf140a         GFPIFFDAGLIVMLPIVFATARRMKQDVLPFALASIGAFSVMHVFLPPHPGPIAASEFYG   810 orf140-1.pep    ANIGQVLILGLPTAFITWYFSGYMLGKVLGRTIHVPVPELLSGGTQDNDLPKEPAKAGTV   240
                ||||||||||||||||||||||||||||||||||||||||||||||||||||||||||||
orf140a         ANIGQVLILGLPTAFITWYFSGYMLGKVLGRTIHVPVPELLSGGTQDNDLPKEPAKAGTV   240 orf140-1.pep    VAIMLIPMLLIFLNTGVSALISEKLVSADETWVQTAKIIGSTPIALLISVLVALFVLGRK   300
                ||||||||||||||||||||||||||||||||||||||||||||||||||||||||||||
orf140a         VAIMLIPMLLIFLNTGVSALISEKLVSADETWVQTAKIIGSTPIALLISVLVALFVLGRK   300 orf140-1.pep    RGESGSALEKTVDGALAPVCSVILITGAGGMFGGVLRASGIGKALADSMADLGIPVLLGC   360
                ||||||||||||||||||||||||||||||||||||||||||||||||||||||||||||
orf140a         RGESGSALEKTVDGALAPVCSVILITGAGGMFGGVLRASGIGKALADSMADLGIPVLLGC   360 orf140-1.pep    FLVALALRIAQGSATVALTTAAALMAPAVAAAGFTDWQLACIVLATAAGSVGCSHFNDSG   420
                ||||||||||||||||||||||||||||||||||||||||||||||||||||||||||||
orf140a         FLVALALRIAQGSATVALTTAAALMAPAVAAAGFTDWQLACIVLATAAGSVGCSHFNDSG   420 orf140-1.pep    FWLVGRLLDMDVPTTLKTWTVNQTLIALIGFALSALLFAIV    461
                |||||||||||||||||||||||||||||||||||||||||
orf140a         FWLVGRLLDMDVPTTLKTWTVNQTLIALIGFALSALLFAIV    461
```

Homology with a Predicted ORF from *N. gonorrhoeae*

ORF140 shows 92% identity over a 87aa overlap with a predicted ORF (ORF140ng) from *N. gonorrhoeae*:

```
orf140.pep      MDGWTQTLSAQTLLGISAAAIILILILIVRFRIHALLTLVIVSLLTALATGLPTGSIVKD    60
                |||:||||||||||||||||||||||||||:|||:|||||||:||||||||||||||||:
orf140ng        MDGRTQTLSAQTLLGISAAAIILILILIVKFRIRALLTLVIASLLTALATGLPTGSIVND    60 orf140.pep      ILVKNFGGTLGGVALLVGLGAMLERLV                                    87
                :||||||||||||||||||||||| ||
orf140ng        VLVKNFGGTLGGVALLVGLGAMLGRLVETSGGAQSLADALIRMFGEKRAPFAPGVASLIF   120
```

The complete length ORF140ng nucleotide sequence <SEQ ID 589> was predicted to encode a protein having amino acid sequence <SEQ ID 590>:

```
  1 MDGRTQTLSA QTLLGISAAA IILILILIVK FRIRALLTLV IASLLTALAT

51 GLPTGSIVND VLVKNFGGTL GGVALLVGLG AMLGRLVETS GGAQSLADAL

101 IRMFGEKRAP FAPGVASLIF GFPIFFDAGL IVMLPIVFAT ARRMKQDVLP

151 FALASVGAFS VMHVFLPPHP GPIAASEFYG ANIGQVLILG LPTAFITWYF

201 SGYMLGKVLG RAIHVPVPEL SGGTQDSDP  PKEPAKAGTV VAVMLIPMLL

251 IFLNTGVSAL ISEKLVSADE TWVQTAKMIG STPVALLISV LAALLVLGRK

301 RGESGSTLEK TVDGALAPAC SVILITGAGG MFGGVLRASG IGKALADSMA

351 DLGIPVLLGC FLVALALRIA QGSATVALTT AAALMAPAVA AAGFTDWQLA
```

```
401 CIVLATAAGS VGCSHFNDSG FWLVGRLSDM DVPTTLKTWT VNQTLIAFIG

451 FALSALLFAI V*
```

Further work revealed a variant gonococcal DNA sequence <SEQ ID 591>:

```
   1 ATGGACGGCC GGACACAGAC GCTGTCCGCG CAAACCTTGT TGGGCATTTC
  51 GGCGGCGGCA ATCATCCTCA TTCTGATTTT AATCGTCAAA TTCCGCATCC
 101 GCGCGCTGCT GACACTGGTC ATCGCCAGCC TGCTGACGGC TTTGGCAACC
 151 GGTTTGCCCA CAGGCAGCAT CGTCAACGAC GTACTGGTCA AAAACTTCGG
 201 CGGCACGCTC GGCGGCGTGG CGCTTCTGGT CGGTCTGGGC GCAATGCTCG
 251 GACGTTTGGT AGAAACATCC GGCGGCGCAC AGTCGCTGGC GGACGCGCTG
 301 ATCCGGATGT TCGGCGAAAA ACGCGCACCG TTCGCTCCGG GCGTTGCCTC
 351 GCTGATTTTC GGCTTCCCGA TTTTCTTCGA TGCCGGACTA ATCGTCATGC
 401 TGCCCATCGT ATTCGCCACC GCACGGCGCA TGAAACAGGA CGTACTGCCC
 451 TTCGCGCTTG CCTCCGTCGG CGCATTTTCC GTCATGCACG TCTTCCTGCC
 501 GCCCCATCCG GGCCCGATTG CCGCTTCCGA ATTTTACGGC GCGAACATCG
 551 GCCAGGTTTT GATTTGGGT CTGCCGACCG CCTTCATCAC ATGGTATTTC
 601 AGCGGCTATA TGCTCGGCAA AGTGTTGGGG CGCGCCATCC ATGTTCCCGT
 651 TCCCGAACTG CTCAGCGGCG GCACGCAAGA CAGCGACCCG CCGAAAGAAC
 701 CTGCCAAAGC AGGAACGGTC GTCGCCGTCA TGCTGATTCC CATGCTGCTG
 751 ATTTTCCTGA ATACCGGCGT ATCAGCCCTC ATCAGCGAAA AACTCGTAAG
 801 TGCGGACGAA ACTTGGGTTC AGACGGCAAA AATGATCGGT TCGACACCTG
 851 TCGCCCTTCT GATTTCCGTA TTGGCCGCAC TGTTGGTCTT GGGACGCAAA
 901 CGCGGCGAAA GCGGCAGCAC GTTGGAAAAA ACCGTGGACG GCGCACTCGC
 951 CCCCGCCTGT TCCGTGATTC TGATTACCGG CGCGGGCGGT ATGTTCGGCG
1001 GCGTTTTGCG CGCTTCCGGC ATCGGCAAGG CACTCGCCGA CAGCATGGCG
1051 GATTTGGGCA TTCCCGTCCT TTTGGGCTGC TTCCTTGTCG CCTTGGCACT
1101 GCGTATCGCG CAAGGTTCGG CAACCGTCGC CCTGACCACA GCCGCCGCGC
1151 TGATGGCTCC TGCCGTTGCC GCCGCCGGCT TTACCGACTG GCAGCTCGCC
1201 TGTATCGTAT TGGCAACGGC GGCAGGTTCG GTCGGTTGCA GCCACTTCAA
1251 CGACTCCGGC TTCTGGCTGG TCGGCCGCCT CTTGGATATG GACGTACCGA
1301 CCACGCTGAA AACCTGGACG GTCAACCAAA CCCTCATCGC ATTCATCGGC
1351 TTTGCCTTGT CCGCACTGCT GTTTGCCATC GTCTGA
```

This corresponds to the amino acid sequence <SEQ ID 592; ORF140ng-1>:

```
   1 MDGRTQTLSA QTLLGISAAA IILILILIVK FRIRALLTLV IASLLTALAT
  51 GLPTGSIVND VLVKNFGGTL GGVALLVGLG AMLGRLVETS GGAQSLADAL
 101 IRMFGEKRAP FAPGVASLIF GFPIFFDAGL IVMLPIVFAT ARRMKQDVLP
```

```
151 FALASVGAFS VMHVFLPPHP GPIAASEFYG ANIGQVLILG LPTAFITWYF

201 SGYMLGKVLG RAIHVPVPEL LSGGTQDSDP PKEPAKAGTV VAVMLIPMLL

251 IFLNTGVSAL ISEKLVSADE TWVQTAKMIG STPVALLISV LAALLVLGRK

301 RGESGSTLEK TVDGALAPAC SVILITGAGG MFGGVLRASG IGKALADSMA

351 DLGIPVLLGC FLVALALRIA QGSATVALTT AAALMAPAVA AAGFTDWQLA

401 CIVLATAAGS VGCSHFNDSG FWLVGRLLDM DVPTTLKTWT VNQTLIAFIG

451 FALSALLFAI V*
```

ORF140ng-1 and ORF140-1 show 96.3% identity over 461aa overlap:

```
orf140ng-1.pep  MDGRTQTLSAQTLLGISAAAIILILILIVKFRIRALLTLVIASLLTALATGLPTGSIVND
                ||| ||||||||||||||||||||||||||||| ||||| ||:|||||||||||||||||
orf140-1        MDGWTQTLSAQTLLGISAAAIILILILIVKFRIHALLTLVIVSLLTALATGLPTGSIVND orf140ng-1.pep  VLVKNFGGTLGGVALLVGLGAMLGRLVETSGGAQSLADALIRMFGEKRAPFAPGVASLIF
                :|||||||||||||||||||||||||||||||||||||||||||||||||||| |||||
orf140-1        ILVKNFGGTLGGVALLVGLGAMLGRLVETSGGAQSLADALIRMFGEKRAPFALGVASLIF orf140ng-1.pep  GFPIFFDAGLIVMLPIVFATARRMKQDVLPFALASVGAFSVMHVFLPPHPGPIAASEFYG
                ||||||||||||||||||||||||||||||||||||:|||||||||||||||||||||||
orf140-1        GFPIFFDAGLIVMLPIVFATARRMKQDVLPFALASIGAFSVMHVFLPPHPGPIAASEFYG orf140ng-1.pep  ANIGQVLILGLPTAFITWYFSGYMLGKVLGRAIHVPVPELLSGGTQDSDPPKEPAKAGTV
                ||||||||||||||||||||||||||||||||:|||||||||||||||:|||||||||||
orf140-1        ANIGQVLILGLPTAFITWYFSGYMLGKVLGRTIHVPVPELLSGGTQDNDLPKEPAKAGTV orf140ng-1.pep  VAVMLIPMLLIFLNTGVSALISEKLVSADETWVQTAKMIGSTPVALLISVLAALLVLGRK
                ||:|||||||||||||||||||||||||||||||||:|||||:||||||||:|:||||||
orf140-1        VAIMLIPMLLIFLNTGVSALISEKLVSADETWVQTAKIIGSTPIALLISVLAVFVLGRK orf140ng-1.pep  RGESGSTLEKTVDGALAPACSVILITGAGGMFGGVLRASGIGKALADSMADLGIPVLLGC
                |||||:|||||||||||:||||||||||||||||||||||||||||||||||||||||||
orf140-1        RGESGSALEKTVDGALAPVCSVILITGAGGMFGGVLRASGIGKALADSMADLGIPVLLGC orf140ng-1.pep  FLVALALRIAQGSATVALTTAAALMAPAVAAAGFTDWQLACIVLATAAGSVGCSHFNDSG
                ||||||||||||||||||||||||||||||||||||||||||||||||||||||||||||
orf140-1        FLVALALRIAQGSATVALTTAAALMAPAVAAAGFTDWQLACIVLATAAGSVGCSHFNDSG orf140ng-1.pep  FWLVGRLLDMDVPTTLKTWTVNQTLIAFIGFALSALLFAIV
                ||||||||||||||||||||||||||||:||||||||||||
orf140-1        FWLVGRLLDMDVPTTLKTWTVNQTLIALIGFALSALLFAIV
```

Furthermore, ORF140ng-1 is homologous to an *E. coli* protein:

```
gi|882633 (U29579) ORF_o454 [Escherichia coli] >gi|1789097 (AE000358)
o454; This 454 aa ORF is 34% identical (9 gaps) to 444 residues of an
approx. 456 aa protein GNTP_BACLI SW: P46832 [Escherichia coli]
  Length = 454 Score = 210 bits (529), Expect = 1e-53
  Identities = 130/384 (33%), Positives = 194/384 (49%),
  Gaps = 19/384 (4%)

Query:  88  ETSGGAQSLADALIRMFGEKRAPFAPCVASLIFGFPIFFDAGLIVMLPIVFATARRMKQD 147
            E SGGA+SLA+   R G+KR  A  +A+   G P+FFD G I++ PI++  A+    K
Sbjct:  80  EHSGGAESLANYFSRKLGDKRTIAALTLAAFFLGIPVFFDVGFIILAPIIYGFAKVAKIS 139

Query: 148  VLPFALASVGAFSVMHVFLPPHPGPIAASEFYGANIGQVLILGLPTAFITWYFSGYMLGK 207
              L F L    G    +HV +PPHPGP+AA+    A+IG + I+G+ + I    GY  K
Sbjct: 140  PLKFGLPVAGIMLTVHVAVPPHPGPVAAAGLLHADIGWLTIIGIAIS-IPVGVVGYFAAK 198

Query: 208  VLGRAIHVPVPELL---------SGGTQDSDPPKEPAKAGTVVAVMLIPMLLIFLNTGV 257
            ++ +  +    E+L          G T+ SD    P A V ++++IP+ +I      T
Sbjct: 199  IINKRQYAMSVEVLEQMQLAPASEEGATKLSDKINPPGVA-LVTSLIVIPIAIIMAGT-- 255

Query: 258  SALISEKLVSADETWVQTAKMIGSTPXXXXXXXXXXXXXXGRKRGESGSTLEKTVDGALA 317
              +S  L+    + T ++IGS             +RG S      + AL
Sbjct: 256  ---VSATLMPPSHPLLGTLQLIGSPMVALMIALVLAFWLLALRRGWSLQHTSDIMGSALP 312

Query: 318  PACSVILITGAGGMFGGVLRASGIGKALADSMADLGIPVLLGCFLVALALRIAQGSXXXX 377
               A  VIL+TGAGG+FG VL  SG+GKALA+ +   + +P+L   F+++LALR +QGS
Sbjct: 313  TAAVVILVTGAGGVFGKVLVESGVGKALANMLQMIDLPLLPAAFIISLALRASQGS--AT 370
```

```
-continued
Query:  378 XXXXXXXXXXXXXXXGFTDWQLACIVLATAAGSVGCSHFNDSGFWLVGRLLDMDVPTTLK 437
                            G   Q   + LA   G +G SH NDSGFW+V + L + V    LK
Sbjct:  371 VAILTTGGLLSEAVMGLNPIQCVLVTLAACFGGLGASHINDSGFWIVTKYLGLSVADGLK 430

Query:  438 TWTVNQTLIAFIGFALSALLFAIV                                     461
            TWTV   T++ F GF ++  ++A++
Sbjct:  431 TWTVLTTILGFTGFLITWCVWAVI                                     454
```

Based on this analysis, including the identification of the presence of a putative leader sequence (double-underlined) and several putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 71

The following partial DNA sequence was identified in *N. meningitidis* <SEQ ID 593>:

```
  1 ..GATTTCGGCA TATCGCCCGT GTATCTTTGG GTTGCCGCCG CGTTCAAACA

51   TTTGCTGTCG CCGTGGGCTG CCGACTCATA CGATGTCGCA CGCTTTGCAG

101   GCGTATTTTT TGCCGTTATC GGACTGACTT CCTGCGGCTT TGCCGGTTTC

151   AACTTTTTGG GCAGACACCA CGGGCGCAC. GTCGTCCTGA TTCTCATCGG

201   CTGTATCGGG CTGATTCCAG TTGCCCATTT CCTCAACCCC GCTGCCGCCG

251   CCTTTGCCGC CGCCGGACTG GTGCTGCACG GTTATTCTTT GGCTCGCCGG

301   CGCGTGATTG CCGCCTCTTT TCTGCTCGGT ACGGGCTGGA CGCTGATGTC

351   GTTGGCAGCA GCTTATCCGG CAGCATTTGC CCTGATGCTG CCCTTGCCCG

401   TACTGATGTT TTTCCGTCCG ..
```

This corresponds to the amino acid sequence <SEQ ID 594; ORF141>:

```
  1 ..DFGISPVYLW VAAAFKHLLS PWAADSYDVA RFAGVFFAVI GLTSCGFAGF

51   NFLGRHHGRX VVLILIGCIG LIPVAHFLNP AAAAFAAAGL VLHGYSLARR

101   RVIAASFLLG TGWTLMSLAA AYPAAFALML PLPVLMFFRP ..
```

Further work revealed the complete nucleotide sequence <SEQ ID 595>:

```
  1 ATGCTGACCT ATACCCCGCC CGATGCCCGC CCGCCCGCCA AAACCCACGA

51 AAAGCCGTGG CTGCTGCTGT TGATGGCGTT TGCCTGGTTG TGGCCCGGCG

101 TGTTTTCCCA CGATTTGTGG AATCCTGACG AACCTGCCGT CTATACCGCC

151 GTCGAAGCAC TGGCAGGCAG CCCCACCCCC TTGGTTGCCC ATCTGTTCGG

201 TCAAACCGAT TTCGGCATAC CGCCCGTGTA TCTTTGGGTT GCCGCCGCGT

251 TCAAACATTT GCTGTCGCCG TGGGCTGCCG ACTCATACGA TGCCGCACGC

301 TTTGCAGGCG TATTTTTTGC CGTTATCGGA CTGACTTCCT GCGGCTTTGC

351 CGGTTTCAAC TTTTTGGGCA GACACCACGG GCGCAgCGTC GTCCTGATTC
```

-continued

```
 401 TCATCGGCTG TATCGGGCTG ATTCCAGTTG CCCATTTCCT CAACCCCGCT
 451 GCCGCCGCCT TTGCCGCCGC CGGACTGGTG CTGCACGGTT ATTCTTTGGC
 501 TCGCCGGCGC GTGATTGCCG CCTCTTTTCT GCTCGGTACG GGCTGGACGC
 551 TGATGTCGTT GGCAGCAGCT TATCCGGCAG CATTTGCCCT GATGCTGCCC
 601 TTGCCCGTAC TGATGTTTTT CCGTCCGTGG CAAAGCAGGC GTTTGATGTT
 651 GACGGCAGTC GCCTCACTTG CCTTTGCCCT GCCGCTTATG ACCGTTTACC
 701 CGCTGCTCTT GGCAAAAACG CAGCCCGCGC TGTTCGCGCA ATGGCTCGAC
 751 TATCACGTTT TCGGTACGTT CGGCGGCGTG CGGCACGTTC AGACGGCATT
 801 CAGTTTGTTT TACTATCTGA AAAACCTGCT TTGGTTTGCA TTGCCCGCGC
 851 TGCCGCTGGC GGTTTGGACG GTTTGCCGCA CGCGCCTGTT TTCGACCGAC
 901 TGGGGGATTT TGGGCGTCGT CTGGATGCTT GCCGTTTTGG TGCTGCTTGC
 951 CGTCAATCCG CAGCGTTTTC AGGATAACCT CGTCTGGCTG CTTCCGCCGC
1001 TTGCCCTGTT CGGCGCGGCG CAACTGGACA GCCTGAGGCG CGGCGCGGCG
1051 GCGTTTGTCA ACTGGTTCGG CATTATGGCG TTCGGACTGT TTGCCGTGTT
1101 CCTGTGGACG GGCTTTTTCG CCATGAATTA CGGCTGGCCC GCCAAGCTTG
1151 CCGAACGCGC CGCCTATTTC AGCCCGTATT ATGTTCCTGA TATCGATCCC
1201 ATTCCGATGG CGGTTGCCGT ACTGTTCACA CCCTTGTGGC TGTGGGCGAT
1251 TACCCGGAAA AACATACGCG GCAGGCAGGC GGTTACCAAC TGGGCGGCAG
1301 GCGTTACCCT GACCTGGGCT TGCTGATGA CGCTGTTCCT GCCGTGGCTG
1351 GACGCGGCGA AAAGCCACGC GCCGGTCGTC CGGAGTATGG AGGCATCGCT
1401 TTCCCCGGAA TTGAAACGGG AGCTTTCAGA CGGCATCGAG TGTATCGGCA
1451 TAGGCGGCGG CGACCTGCAC ACGCGGATTG TTTGGACGCA GTACGGCACA
1501 TTGCCGCACC GCGTCGGCGA TGTACAATGC CGCTACCGCA TCGTCCTCCT
1551 GCCCCAAAAT GCGGATGCGC CGCAAGGCTG GCAGACGGTT TGGCAGGGTG
1601 CGCGTCCGCG CAACAAAGAC AGTAAGTTCG CACTGATACG GAAAATCGGG
1651 GAAAATATAT AA
```

This corresponds to the amino acid sequence <SEQ ID 45 NO 596; ORF141-1>:

```
  1 MLTYTPPDAR PPAKTHEKPW LLLLMAFAWL WPGVFSHDLW NPDEPAVYTA
 51 VEALAGSPTP LVAHLFGQTD FGIPPVYLWV AAAFKHLLSP WAADSYDAAR
101 FAGVFFAVIG LTSCGFAGFN FLGRHHGRSV VLILIGCIGL IPVAHFLNPA
151 AAAFAAAGLV LHGYSLARRR VIAASFLLGT GWTLMSLAAA YPAAFALMLP
201 LPVLMFFRPW QSRRLMLTAV ASLAFALPLM TVYPLLLAKT QPALFAQWLD
251 YHVFGTFGGV RHVQTAFSLF YYLKNLLWFA LPALPLAVWT VCRTRLFSTD
301 WGILGVVWML AVLVLLAVNP QRFQDNLVWL LPPLALFGAA QLDSLRRGAA
351 AFVNWFGIMA FGLFAVFLWT GFFAMNYGWP AKLAERAAYF SPYYVPDIDP
401 IPMAVAVLFT PLWLWAITRK NIRGRQAVTN WAAGVTLTWA LLMTLFLPWL
451 DAAKSHAPVV RSMEASLSPE LKRELSDGIE CIGIGGGDLH TRIVWTQYGT
```

```
501 LPHRVGDVQC RYRIVLLPQN ADAPQGWQTV WQGARPRNKD SKFALIRKIG

551 ENI*
```

Computer analysis of this amino acid sequence gave the following results:

Homology with a Predicted ORF from *N. meningitidis* (Strain A)

ORF141 shows 95.0% identity over a 140aa overlap with an ORF (ORF141a) from strain A of *N. meningitidis*:

```
                                                   10        20        30
    orf141.pep                                DFGISPVYLWVAAAFKHLLSPWAADSYDVA
                                              |||| |||||||||||||||||||||| :|
    orf141a    WNPDEPAVYTAVEALAGSPTPLVAHLFGQIDFGIPPVYLWVAAAFKHLLSPWAADPYDAA
                  40        50        60        70        80        90
                   40        50        60        70        80        90
    orf141.pep  RFAGVFFAVIGLTSCGFAGFNFLGRHHGRXVVLILIGCIGLIPVAHFLNPAAAAFAAAGL
                ||||||||| :|||||||||||||||||||| ||||||||||| :||| |||||||||||
    orf141a     RFAGVFFAVVGLTSCGFAGFNFLGRHHGRSVVLILIGCIGLIPTVHFLNPAAAAFAAAGL
                  100       110       120       130       140       150
                        100       110       120       130       140
    orf141.pep  VLHGYSLARRRVIAASFLLGTGWTLMSLAAAYPAAFALMLPLPVLMFFRP
                ||||||||||||||||||||||||||||||||||||||||||||||||||
    orf141a     VLHGYSLARRRVIAASFLLGTGWTLMSLAAAYPAAFALMLPLPVLMFFRPWQSRRLMLTA
                  160       170       180       190       200       210
    orf141a     VASLAFALPLMTVYPLLLAKTQPALFAQWLDDHVFGTFGGVRHIQTAFSLFYYLKNLLWF
                  220       230       240       250       260       270
```

The complete length ORF141a nucleotide sequence <SEQ ID 597> is:

```
  1    ATGCTGACCT ATACCCCGCC CGATGCCCGC CCGCCCGCCA AAACCCACGA

51    AAAGCCGTGG CTGTTGCTGT TGATGGCGTT TGCCTGGTTG TGGCCCGGCG

101    TGTTTTCCCA CGATTTGTGG AATCCTGACG AACCTGCCGT CTATACCGCC

151    GTCGAAGCAC TGGCAGGCAG CCCCACCCCT TTGGTTGCCC ATCTGTTCGG

201    TCAAATCGAT TTCGGCATAC CGCCCGTGTA TCTTTGGGTT GCCGCCGCGT

251    TCAAACATTT GCTGTCGCCG TGGGCTGCCG ACCCGTATGA TGCCGCACGC

301    TTTGCCGGCG TGTTTTTCGC CGTTGTCGGA CTGACTTCCT GCGGCTTTGC

351    CGGTTTCAAC TTTTTGGGCA GACACCACGG GCGCAGCGTC GTCCTGATTC

401    TCATCGGCTG TATCGGGCTG ATTCCGACCG TACACTTTCT CAACCCCGCT

451    GCCGCCGCCT TTGCCGCCGC CGGACTGGTG CTGCACGGTT ATTCTTTGGC

501    TCGCCGGCGC GTGATTGCCG CCTCTTTTCT GCTCGGTACG GGTTGGACGC

551    TGATGTCGTT GGCAGCAGCT TATCCGGCGG CATTTGCCCT GATGCTGCCC

601    CTGCCCGTGC TGATGTTTTT CCGTCCGTGG CAAAGCAGGC GTTTGATGTT

651    GACGGCAGTC GCCTCGCTTG CCTTTGCCCT GCCGCTTATG ACCGTTTACC

701    CGCTGCTCTT GGCAAAAACG CAGCCCGCGC TGTTCGCGCA ATGGCTCGAC

751    GATCACGTTT TCGGTACGTT CGGCGGCGTG CGGCACATTC AGACGGCATT

801    CAGTTTGTTT TACTATCTGA AAAACCTGCT TTGGTTTGCA TTGCCTGCGC

851    TGCCGCTGGC GGTTTGGACG GTTTGCCGCA CGCGCCTGTT TTCGACCGAC

901    TGGGGGATTT TGGGCGTCGT CTGGATGCTT GCCGTTTTGG TGCTGCTTGC

951    CGTCAATCCG CAGCGTTTTC AGGATAACCT CGTCTGGCTG CTTCCGCCGC
```

```
                               -continued
1001    TTGCCCTGTT  CGGCGCGGCG  CAACTGGACA  GCCTGAGACG  CGGCGCGGCG

1051    GCGTTTGTCA  ACTGGTTCGG  CATTATGGCG  TTCGGACTGT  TTGCCGTGTT

1101    CCTGTGGACG  GGCTTTTTCG  CCATGAATTA  CGGCTGGCCC  GCCAAGCTTG

1151    CCGAACGCGC  CGCCTATTTC  AGCCCGTATT  ATGTTCCTGA  TATCGATCCC

1201    ATTCCGATGG  CGGTTGCCGT  ACTGTTCACA  CCCTTGTGGC  TGTGGGCGAT

1251    TACCCGCAAA  ACATACGCG   GCAGGCAGGC  GGTTACCAAC  TGGGCGGCAG

1301    GCGTTACCCT  GACCTGGGCT  TTGCTGATGA  CGCTGTTCCT  GCCGTGGCTG

1351    GACGCGGCGA  AAAGCCACGC  GCCCCTCGTC  CGGAGTATGG  AGGCATCGCT

1401    TTCCCCGGAA  TTAAAACGGG  AGCTTTCAGA  CGGCATCGAG  TGTATCGACA

1451    TAGGCGGCGG  CGACCTACAC  ACGCGGATTG  TTTGGACGCA  GTACGGCACA

1501    TTGCCGCACC  GCGTCGGCGA  TGTACAATGC  CGCTACCGCA  TCGTCCGCTT

1551    GCCCCAAAAC  GCGGATGCGC  CGCAAGGCTG  GCAGACGGTC  TGGCAGGGTG

1601    CGCGCCCGCG  CAACAAAGAC  AGTAAGTTCG  CACTGATACG  GAAAACCGGG

1651    GAAAATATAT  TAAAAACAAC  AGATTGA
```

This encodes a protein having amino acid sequence <SEQ ID 598>:

```
  1    MLTYTPPDAR FPAKTHEKPW LLLLMAFAWL WPGVFSRDLW NPDEPAVYTA

51    VEALAGSPTP LVAHLFGQID FGIFPVYLWV AAAFKHLLSP WAADPYDAAR

101    FAGVFFAVVG LTSCGFAGFN FLGRHHGRSV VLILIGCIGL IPTVHFLNPA

151    AAAFAAAGLV LHGYSLARRR VIAASFLLGT GWTLMSLAAA YPAAFALMLP

201    LPVLMFFRPW QSRRLMLTAV ASLAFALPLM TVYPLLLAKT QPALFAQWLD

251    DHVFGTFGGV RHIQTAFSLF YYLKNLLWFA LPALPLAVWT VCRTRLFSTD

301    WGILGVVWML AVLVLLAVNP QRFQDNLVWL LPPLALFGAA QLDSLRRGAA

351    AFVNWFGIMA FGLFAVFLWT GFFAMNYGWP AKLAERAAYF SPYYVPDIDP

401    IPMAVAVLFT PLWLWAITRK NIRGRQAVTN WAAGVTLTWA LLMTLFLPWL

451    DAAKSHAPVV RSMEASLSFE LKRELSDGIE CIDIGGGDLH TRIVWTQYGT

501    LPHRVGDVQC RYRIVRLPQN ADAPQGWQTV WQGARPRNKD SKFALIRKTG

551    ENILKTTD*
                                                          50
```
ORF141a and ORF141-1 show 98.2% identity in 553 aa overlap:

```
orf141a.pep     MLTYTPPDARPPAKTHEKPWLLLLMAFAWLWPGVFSHDLWNPDEPAVYTAVEALAGSPTP
                ||||||||||||||||||||||||||||||||||||||||||||||||||||||||||||
orf141-1        MLTYTPPDARPPAKTHEKPWLLLLMAFAWLWPGVFSHDLWNPDEPAVYTAVEALAGSPTP orf141a.pep     LVAHLFGQIDFGIPPVYLWVAAAFKHLLSPWAADPYDAARFAGVFFAVVGLTSCGFAGFN
                ||||||||||:||||||||||||||||||||||||||||||||||||||:||||||||||
orf141-1        LVAHLFGQTDFGIPPVYLWVAAAFKHLLSPWAADSYDAARFAGVFFAVIGLTSCGFAGFN orf141a.pep     FLGRHHGRSVVLILIGCIGLIPTVHFLNPAAAAFAAAGLVLHGYSLARRRVIAASFLLGT
                |||||||||||||||||||||::|||||||||||||||||||||||||||||||||||||
orf141-1        FLGRHHGRSVVLILIGCIGLIPVAHFLNPAAAAFAAAGLVLHGYSLARRRVIAASFLLGT orf141a.pep     GWTLMSLAAAYPAAFALMLPLPVLMFFRPWQSRRLMLTAVASLAFALPLMTVYPLLLAKT
                ||||||||||||||||||||||||||||||||||||||||||||||||||||||||||||
orf141-1        GWTLMSLAAAYPAAFALMLPLPVLMFFRPWQSRRLMLTAVASLAFALPLMTVYPLLLAKT
```

```
orf141a.pep   QPALFAQWLDDHVFGTFGGVRHIQTAFSLFYYLKNLLWFALPALPLAVWTVCRTRLFSTD
              |||||||||| |||||||||||| ||||||||||||||||||| | |||||||||||||
orf141-1      QPALFAQWLDYHVFGTFGGVRHVQTAFSLFYYLKNLLWFALPALTLAVWTVCRTRLFSTD orf141a.pep   WGILGVVWMLAVLVLLAVNPQRFQDNLVWLLPPLALFGAAQLDSLRRGAAAFVNWFGIMA
              ||||||||||||||||||||||||||||||||||||||||||||||||||||||||||||
orf141-1      WGILGVVWMLAVLVLLAVNPQRFQDNLVWLLPPLALFGAAQLDSLRRGAAAFVNWFGIMA orf141a.pep   FGLFAVFLWTGFFAMNYGWPAKLAERAAYFSPYYVPDIDPIPMAVAVLFTPLWLWAITRK
              ||||||||||||||||||||||||||||||||||||||||||||||||||||||||||||
orf141-1      FGLFAVFLWTGFFAMNYGWPAKLAERAAYFSPYYVPDIDPIPMAVAVLFTPLWLWAITRK orf141a.pep   NIRGRQAVTNWAAGVTLTWALLMTLFLPWLDAAKSHAPVVRSMEASLSPELKRELSDGIE
              ||||||||||||||||||||||||||||||||||||||||||||||||||||||||||||
orf141-1      NIRGRQAVTNWAAGVTLTWALLMTLFLPWLDAAKSHAPVVRSMEASLSPELKRELSDGIE orf141a.pep   CIDIGGGDLHTRIVWTQYGTLPHRVGDVQCRYRIVRLPQNADAPQGWQTVWQGARPRNKD
              || |||||||||||||||||||||||||||||||| ||||||||||||||||||||||||
orf141-1      CIGIGGGDLHTRIVWTQYGTLPHRVGDVQCRYRIVLLPQNADAPQGWQTVWQGARPRNKD orf141a.pep   SKFALIRKTGENI
              |||||||| ||||
orf141-1      SKFALIRKIGENI
```

Homology with a Predicted ORF from *N. gonorrhoeae*

ORF141 shows 95% identity over a 140aa overlap with a predicted ORF (ORF141ng) from *N. gonorrhoeae*:

```
orf141.pep                                DFGISPVYLWVAAAFKHLLSPWAADSYDVA    30
                                          |||| |||||||||||||||||||| |:|
orf141ng      WNPAEPAVYTAVEALAGSPTPLVAHLFGQTDFGIPPVYLWVAAAFKHLLSPWAAHPYDAA   126 orf141.pep    RFAGVFFAVIGLTSCGFAGFNFLGRHHGRXVVLILIGCIGLIPVAHFLNPAAAAFAAAGL   90
              |||||||||||||||||||||||||||||| ||| |||||||||||:|||||||||||||
orf141ng      RFAGVFFAVIGLTSCGFAGFNFLGRHHGRSVVLIHIGCIGLIPVAHFFNPAAAAFAAAGL   186 orf141.pep    VLHGYSLARRRVIAASFLLGTGWTLMSLAAAYPAAFALMLPLPVLMFFRP            140
              ||||||||||||||||||||||||||||||||||||||||||||||||||
orf141ng      VLHGYSLARRRVIAASFLLGTGWTLMSLAAAYPAAFALMLPLPVLMFFRPWQSRRLMLTA   246
```

An ORF141ng nucleotide sequence <SEQ ID 599> was predicted to encode a protein having amino acid sequence <SEQ ID 600>:

```
  1  MPSEAVSARP LCEYLLHLAI RPFLLTLMLT YTPPDARPPA KTHEKPWLLL

51  LMAFAWLWPG VFSHDLWNPA EPAVYTAVEA LAGSPTPLVA HLFGQTDFGI

101  PPVYLWVAAA FKHLLSPWAA HPYDAARFAG VFFAVIGLTS CGFAGFNFLG

151  RHHGRSVVLI HIGCIGLIPV AHFFNPAAAA FAAAGLVLHG YSLARRRVIA

201  ASFLLGTGWT LMSLAAAYPA AFALMLPLFV LMFFRPWQSR RLMLTAVASL

251  AFALPLMTVY PLLLAKTQPA LFAQWLNYHV FGTFGGVRHI QRAFSLFHYL

301  KNLLWFAPPG LPLAVWTVCR TRLFSTDWGI LGIVWMLAVL VLLAFNPQRF

351  QDNLVWLLPP LALFGAAQLD SLRRGAAAFV NWFGIMAFGL FAVFLWTGFF

401  AMNYGWPAKL AERAAYFSPY YVFDIDPIPM AVAVLFTPLW LWAITRKNIR

451  GRQAVTNWAA GVTLTWALLM TLFLPWLDAA KSHAPVVRSM EASFSPELKR

501  ELSDGIECIG IGGGDLHTRI VWTQYGTLPH RVGDVRCRYR IVRLPQNADA

551  PQGWQTVWQG ARPRNKDSKF ALIRKIGENI LITTD*
```

Further work revealed the following gonococcal DNA sequence <SEQ ID 601>:

```
  1  ATGCTGACCT ATACCCCGCC CGATGCCCGC CCGCCCGCCA AACCCACGA

51  AAAACCGTGG CTGCTGCTGT TCATGGCGTT TGCCTGGCTG TGGCCCGGCG
```

-continued

```
 101   TGTTTTCCCA CGATTTGTGG AATCCTGCCG AACCTGCCGT CTATACCGCC
 151   GTCGAAGCAC TGGCAGGCAG CCCCACCCCC TTGGTTGCCC ATCTGTTCGG
 201   TCAAACCGAT TTCGGCATAC CGCCCGTGTA TCTTTGGGTT GCCGCCGCAT
 251   TCAAACATTT GCTGTCGCCG TGGGCAGCCG ACCCGTATGA TGCCGCACGC
 301   TTTGCAGGCG TATTTTTTGC CGTTATCGGA CTGACTTCTT GCGGCTTTGC
 351   CGGTTTCAAC TTTTTGGGCA GACACCACGG GCGCAGCGTT GTTTTAATCC
 401   ATATCGGCTG TATCGGGCTG ATTCCGGTTG CCCATTTCCT CAATCCcgcc
 451   gccgccgcct tGCCGCCGC CGGACTGGTG CTGCacggct actcgctgGC
 501   ACGCCGGCGC GTGATtgccg cctctTtccT GCTCGGTACG GGTTGGACGT
 551   TGATGTCGCT GGCGGCAGCT TATCCGGCGG CGTTTGCGCT GATGCTGCCC
 601   CTGCCCGTGC TGATGTTTTT CCGTCCGTGG CAAAGCAGGC GTTTGATGTT
 651   GACGGCAGTC GCCTCCCTTG CCTTTGCCCT GCCGCTTATG ACCGTTTACC
 701   CGCTGCTCtt gGCAAAAACG CAGCCCGCGC TGTTTGCGCA ATGGCTCAAC
 751   TATCACGTTT TCGGTACGTt cggcgGCGTG CGGCAcaTTC AGAggGCatT
 801   CagtttgtttCactatctgA AAaatctgct ttggttcgca ccgcccgggC
 851   TGCCGCTGGC GGTTTGGACG GTTTGCCGCA CACGCCTGTT TTCGACCGAC
 901   TGGGGATTT TGGGCATTGT CTGGATGCTT GCCGTTTTGG TGCTGCTCGC
 951   CTTTAATCCG CAGCGTTTTC AAGACAACCT CGTCTGGCTG CTGCCGCCGC
1001   TTGCCCTGTT CGGCGCGGCG CAACTGGACA GCCTGAGGCG CGGCGCGGCG
1051   GCTTTTGTCA ACTGGTTCGG CATTATGCGC TTCGGGCTGT TTGCCGTGTT
1101   CCTGTGGACG GGCTTTTTCG CCATGAATTA CGGCTGGCCC GCCAAGCTTG
1151   CCGAACGCGC CGCCTACTTC AGCCCGTATT ACGTTCCCGA CATCGATCCC
1201   ATTCCGATGG CGGTTGCCGT ACTGTTCACA CCCTTGTGGC TGTGGGCGAT
1251   TACCCGGAAA AACATACGCG GCAGGCAGGC GGTTACCAAC TGGGCGGCAG
1301   GCGTTACCCT GACCTGGGCT TTGCTGATGA CGCTGTTCCT GCCGTGGCTG
1351   GACGCGGCGA AAAGCCACGC GCCCGTCGTC CGGAGTATGG AGGCATCGTT
1401   TTCCCCGGAA TTAAAACGGG AGCTTTCAGA CGGCATCGAG TGTATCGGCA
1451   TAGGCGGCGG CGACCTGCAC ACGCGGATTG TTTGGACGCA GTACGGCACA
1501   TTGCCGCACC GCGTCGGCGA TGTCCGTTGC CGCTACCGTA TCGTCCGCCT
1551   GCCCCAAAAC GCGGATGCGC CGCAAGGCTG GCAGACGGTC TGGCAGGGTG
1601   CGCGCCCGCG CAACAAAGAC AGTAAGTTTG CACTGATACG GAAAATCGGG
1651   GAAAATATAT TAAAAACAAC AGATTGA
```

This corresponds to the amino acid sequence <SEQ ID 602; ORF141ng-1>:

```
  1   MLTYTPPDAR PPAKTHEKPW LLLLMAFAWL WPGVFSHDLW NPAEPAVYTA
 51   VEALAGSPTP LVAHLFGQTD FGIPPVYLWV AAAFKHLLSP WAADPYDAAR
101   FAGVFFAVIG LTSCGFAGFN FLGRHHGRSVVLIHIGCIGLIPVAHFLNPA
151   AAAFAAAGLV LHGYSLARRR VIAASFLLGT GWTLMSLAAA YPAAFALMLP
```

```
201  LPVLMFFRPW QSRRLMLTAV ASLAFALPLM TVYPLLLAKT QPALFAQWLN

251  YHVFGTFGGV RHIQRAFSLF HYLKNLLWFA PPGLPLAVWT VCRTRLFSTD

301  WGILGIVWML AVLVLLAFNP QRFQDNLVWL LPPLALFGAA QLDSLRRGAA

351  AFVNWFGIMA FGLFAVFLWT GFFAMNYGWP AKLAERAAYF SPYYVPDIDP

401  IPMAVAVLFT FLWLWAITRK NIRGRQAVTN WAAGVTLTWA LLMTLFLPWL

451  DAAKSHAPVV RSMEASFSPE LKRELSDGIE CIGIGGGDLH TRIVWTQYGT

501  LPHRVGDVRC RYRIVRLPQN ADAPQGWQTV WQGARPRNKD SKFALIRKIG

551  ENILKTTD*
```

ORF141ng-1 and ORF141-1 show 97.5% identity in 553 aa overlap:

```
orf141ng-1.pep   MLTYTPPDARPPAKTHEKPWLLLLMAFAWLWPGVFSHDLWNPAEPAVYTAVEALAGSPTP
                 ||||||||||||||||||||||||||||||||||||||||| |||||||||||||||||
orf141-1         MLTYTPPDARPPAKTHEKPWLLLLMAFAWLWPGVFSHDLWNPDEPAVYTAVEALAGSPTP orf141ng-1.pep   LVAHLFGQTDFGIPPVYLWVAAAFKHLLSPWAADPYDAARFAGVFFAVIGLTSCGFAGFN
                 |||||||||||||||||||||||||||||||||||| |||||||||||||||||||||||
orf141-1         LVAHLFGQTDFGIPPVYLWVAAAFKHLLSPWAADSYDAARFAGVFFAVIGLTSCGFAGFN orf141ng-1.pep   FLGRHHGRSVVLIHIGCIGLIPVAHFLNPAAAAFAAAGLVLHGYSLARRRVIAASFLLGT
                 |||||||||||||  |||||||||||||||||||||||||||||||||||||||||||||
orf141-1         FLGRHHGRSVVLILIGCIGLIPVAHFLNPAAAAFAAAGLVLHGYSLARRRVIAASFLLGT orf141ng-1.pep   GWTLMSLAAAYPAAFALMLPLPVLMFFRPWQSRRLMLTAVASLAFALPLMTVYPLLLAKT
                 ||||||||||||||||||||||||||||||||||||||||||||||||||||||||||||
orf141-1         GWTLMSLAAAYPAAFALMLPLPVLMFFRPWQSRRLMLTAVASLAFALPLMTVYPLLLAKT orf141ng-1.pep   QPALFAQWLNYHVFGTFGGVRHIQRAFSLFHYLKNLLWFAPPGLPLAVWTVCRTRLFSTD
                 |||||||||| :||||||||||| :|||||| :|||||| :|||||||||||||||||||
orf141-1         QPALFAQWLDYHVFGTFGGVRHVQTAFSLFYYLKNLLWFALPALPLAVWTVCRTRLFSTD orf141ng-1.pep   WGILGIVWMLAVLVLLAFNPQRFQDNLVWLLPPLALFGAAQLDSLRRGAAAFVNWFGIMA
                 ||||| :||||||||||| :||||||||||||||||||||||||||||| ||||||||||
orf141-1         WGILGVVWMLAVLVLLAVNPQRFQDNLVWLLPPLALFGAAQLDSLRRGAAAFVNWFGIMA orf141ng-1.pep   FGLFAVFLWTGFFAMNYGWPAKLAERAAYFSPYYVPDIDPIPMAVAVLFTPLWLWAITRK
                 ||||||||||||||||||||||||||||||||||||||||||||||||||||||||||||
orf141-1         FGLFAVFLWTGFFAMNYGWPAKLAERAAYFSPYYVPDIDPIPMAVAVLFTPLWLWAITRK orf141ng-1.pep   NIRGRQAVTNWAAGVTLTWALLMTLFLPWLDAAKSHAPVVRSMEASFSPELKRELSDGIE
                 |||||||||||||||||||||||||||||||||||||||||||||| :||||||||||||
orf141-1         NIRGRQAVTNWAAGVTLTWALLMTLFLPWLDAAKSHAPVVRSMEASLSPELKRELSDGIE orf141ng-1.pep   CIGIGGGDLHTRIVWTQYGTLPHRVGDVRCRYRIVRLPQNADAPQGWQTVWQGARPRNKD
                 |||||||||||||||||||||||||||| :||||||| ||||||||||||||||||||||
orf141-1         CIGIGGGDLHTRIVWTQYGTLPHRVGDVQCRYRIVLLPQNADAPQGWQTVWQGARPRNKD orf141ng-1.pep   SKFALIRKIGENILKTTDX
                 |||||||||||||
orf141-1         SKFALIRKIGENIX
```

Based on the presence of several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 72

The following partial DNA sequence was identified in *N. meningitidis* <SEQ ID 603>:

```
  1 ..CAATCCGCCA AATGGTTATC GGGCCAAACT CTAGTCGGCA CAGCAATTGG

51   GATACGCGGG CAGATAAAGC TTGGCGGCAA CCTGCATTAC GATATATTTA

101   CCGGCCGCGC ATTGAAAAAG CCCGAATTTT TCCAATCAAG GAAATGGGCA

151   AGCGGTTTTC AGGTAGGCTA TACGTTTTAA
```

This corresponds to the amino acid sequence <SEQ ID 604; ORF142>:

```
  1  ..QSAKLSGQT LVGTAIGIRG QIKLGGNLHY DIFTCRALKK
     PEFFQSRKWA

51  SGFQVGYTF*
```

Further work revealed the complete nucleotide sequence <SEQ ID 605>:

```
    1  ATGGATAATT CGGGTAGTGA GGCGACAGGA AAATACCAAG GAAATATCAC
   51  TTTCTCTGCC GACAATCCTT TGGGACTGAG TCATATGTTC TATGTAAATT
  101  ATGGACGTTC GATTGGCGGT ACGCCCGATG AGGAAAGTTT TGACGGCCAT
  151  CGCAAAGAAG GCGGATCAAA CAATTACGCC GTACATTATT CAGCCCCTTT
  201  CGGTAAATGG ACATGGGCAT TCAATCACAA TGGCTACCGT TACCATCAGG
  251  CAGTTTCCGG ATTATCGGAA GTCTATGACT ATAATGGAAA AAGTTACAAT
  301  ACTGATTTCG GCTTCAACCG CCTGTTGTAT CGTGATGCCA AACGCAAAAC
  351  CTATCTCGGT GTAAAACTGT GGATGAGGGA ACAAAAAGT TACATTGATG
  401  ATGCCGAACT GACTGTACAA CGGCGTAAAA CTGCGGGTTG GTTGGCAGAA
  451  CTTTCCCACA AGAATATAT CGGTCGCAGT ACGGCAGATT TTAAGTTGAA
  501  ATATAAACGC GGCACCGGCA TGAAAGATGC TCTGCGCGCG CCTGAAGAAG
  551  CCTTTGGCGA AGGCACGTCA CGTATGAAAA TTTGGACGGC ATCGGCTGAT
  601  GTAAATACTC CTTTTCAAAT CGGTAAACAG CTATTTGCCT ATGACACATC
  651  CGTTCATGCA CAATGGAACA AACCCCGCT AACATCGCAA GACAAACTGG
  701  CTATCGGCGG ACACCACACC GTACGTGGCT TCGACGGTGA AATGAGTTTG
  751  TCTGCCGAGC GGGGATGGTA TTGGCGCAAC GATTTGAGCT GGCAATTTAA
  801  ACCAGGCCAT CAGCTTTATC TTGGGGCTGA TGTAGGACAT GTTTCAGGAC
  851  AATCCGCCAA ATGGTTATCG GGCCAAACTC TAGTCGGCAC AGCAATTGGG
  901  ATACGCGGGC AGATAAAGCT TGGCGGCAAC CTGCATTACG ATATATTTAC
  951  CGGCCGCGCA TTCAAAAAGC CCGAATTTTT CCAATCAAGG AAATGGGCAA
 1001  GCGGTTTTCA GGTAGGCTAT ACGTTTTAA
```

This corresponds to the amino acid sequence <SEQ ID 606; ORF142-1>:

```
  1  MDNSGSEATG KYQGNITFSA DNPLGLSDMF YVNYGRSIGG TPDEESFDGH
 51  RKEGGSNNYA VHYSAPFGKW TWAFNHNGYR YHQAVSGLSE VYDYNGKSYN
101  TDFGFNRLLY RDAKRKTYLG VKLWMRETKS YIDDAELTVQ RRKTAGWLAE
151  LSHKEYIGRS TADFKLKYKR GTGMKDALRA PEEAFGEGTS RNKIWTASAD
201  VNTPFQIGKQ LFAYDTSVHA QWNKTPLTSQ DKLAIGGHHT VRGFDGEMSL
251  SAERGWYWRN DLSWQFKPGH QLYLGADVGH VSGQSAKWLS GQTLVGTAIG
301  IRGQIKLGGN LHYDIFTGRA LKKPEFFQSR KWASGFQVGY TF*
```

Computer analysis of this amino acid sequence gave the following results:

Homology with a Predicted ORF from *N. gonorrhoeae*
ORF142 shows 88.1% identity over a 59aa overlap with a predicted ORF (ORF142ng) from *N. gonorrhoeae*:

```
orf142.pep                         QSAKWLSGQTLVGTAIGIRGQIKLGGNLHY   30
                                   ||||||||||||:||||||||||||||||| 
orf142ng    RGWYWRNDLSWQFKPGHQLYLGADVGHVSGQSAKWLSGQTLAGTAIGIRGQIKLGGNLHY  313
orf142.pep  DIFTGRALKKPEFFQSRKWASGFQVGYTF   59
            ||||||||||||:||::||::|||||||:| 
orf142ng    DIFTGRALKKPEYFQTKKWVTGFQVGYSF  342
```

The complete length ORF142ng nucleotide sequence <SEQ ID 607> is:

```
   1   ATGGATAATT CGGGTAGTGA GGCGACAGGA AAATACCAAG GAAATATCAC
  51   TTTCTCTGCC GACAATCCTT TTGGACTGAG TGATATGTTC TATGTAAATT
 101   ATGGACGTTC AATTGGCGGT ACGCCCGATG AGGAAAATTT TGACGGCCAT
 151   CGCAAAGAAG GCGGATCAAA CAATTACGCC GTACATTATT CAGCCCCTTT
 201   CGGTAAATGG ACATGGGCAT TCAATCACAA TGGCTACCGT TACCATCAGG
 251   CGGTTTCCGG ATTATCGGAA GTCTATGACT ATAATGGAAA AAGTTACAAC
 301   ACTGATTTCG GCTTCAACCG CCTGTTGTAT CGTGATGCCA AACGCAAAAC
 351   CTATCTCAGT GTAAAACTGT GGACGAGGGA AACAAAAAGT TACATTGATG
 401   ATGCCGAACT GACTGTACAA CGGCGTAAAA CCACAGGTTG GTTGGCAGAA
 451   CTTTCCCACA AAGGATATAT CGGTCGCAGT ACGGCAGATT TTAAGTTGAA
 501   ATATAAACAC GGCACCGGCA TCAAAGATGC TCTGCGCGCG CCTGAAGAAG
 551   CCTTTGGCGA AGGCACGTCA CGTATGAAAA TTTGGACGGC ATCGGCTGAT
 601   GTAAATACTC CTTTTCAAAT CGGTAAACAG CTATTTGCCT ATGACACATC
 651   CGTTCATGCA CAATGGAACA AAACCCCGCT AACATCGCAA GACAAACTGG
 701   CTATCGGCGG ACACCACACC GTACGTGGCT TCGACGGTGA AATGAGTTTG
 751   CCTGCCGAGC GGGGATGGTA TTGGCGCAAC GATTTGAGCT GGCAATTTAA
 801   ACCAGGCCAT CAGCTTTATC TTGGGGCTGA TGTAGGACAT GTTTCAGGAC
 851   AATCCGCCAA ATGGTTATCG GGCCAAACTC TAGCCGGCAC AGCAATTGGG
 901   ATACGCGGGC AGATAAAGCT TGGCGGCAAC CTGCATTACG ATATATTTAC
 951   CGGCCGTGCA TTGAAAAAGC CCGAATATTT TCAGACGAAG AAATGGGTAA
1001   CGGGGTTTCA GGTGGGTTAT TCGTTTTGA
```

This encodes a protein having amino acid sequence <SEQ ID 608>:

```
  1   MDNSGSEATG KYQGNITFSA DNPFGLSDMF YVNYGRSIGG
      TPDEENFDGH
 51   RKEGGSNNYA VHYSAPFGKW TWAFNHNGYR YHQAVSGLSE
      VYDYNGKSYN
101   TDFGFNRLLY RDAKRKTYLS VKLWTRETKS YIDDAELTVQ
      RRKTTGWLAE
151   LSHKGYIGRS TADFKLKYKH GTGMKDALRA PEEAFGEGTS
      RNKIWTASAD
201   VNTPFQIGKQ LFAYDTSVHA QWNKTPLTSQ DKLAIGGHHT
      VRGFDGEMSL
251   PAERGWYWRN DLSWQFKPGH QLYLGADVGH VSGQSAKWLS
      GQTLAGTAIG
301   IRGQIKLGGN LHYDIFTGRA LKKPEYFQTK KWVTGFQVGY
      SF*
```

The underlined sequence (aromatic-Xaa-aromatic amino acid motif) is usually found at the C-terminal end of outer membrane proteins.

ORF142ng and ORF142-1 show 95.6% identity over 342aa overlap:

```
orf142-1.pep    MDNSGSEATGKYQGNITFSADNPLGLSDMFYVNYGRSIGGTPDEESFDGHRKEGGSNNYA
                ||||||||||||||||||||||| |||||||||||||||||||| ||||||||||||||
orf142ng-1      MDNSGSEATGKYQGNITFSADNPFGLSDMFYVNYGRSIGGTPDEENFDGHRKEGGSNNYA orf142-1.pep    VHYSAPFGKWTWAFNHNGYRYHQAVSGLSEVYDYNGKSYNTDFGFNRLLYRDAKRKTYLG
                |||||||||||||||||||||||||||||||||||||||||||||||||||||||||| 
orf142ng-1      VHYSAPFGKWTWAFNHNGYRYHQAVSGLSEVYDYNGKSYNTDFGFNRLLYRDAKRKTYLS orf142-1.pep    VKLWMRETKSYIDDAELTVQRRKTAGWLAELSHKEYIGRSTADFKLKYKRGTGMKDALRA
                ||||  |||||||||||||||||||| |||||||| |||||||||||||| ||||||||
orf142ng-1      VKLWTRETKSYIDDAELTVQRRKTTGWLAELSHKGYIGRSTADFKLKYKHGTGMKDALRA orf142-1.pep    PEEAFGEGTSRMKIWTASADVNTPFQIGKQLFAYDTSVHAQWNKTPLTSQDKLAIGGHHT
                ||||||||||||||||||||||||||||||||||||||||||||||||||||||||||
orf142ng-1      PEEAFGEGTSRMKIWTASADVNTPFQIGKQLFAYDTSVHAQWNKTPLTSQDKLAIGGHHT orf142-1.pep    VRGFDGEMSLSAERGWYWRNDLSWQFKPGHQLYLGADVGHVSGQSAKWLSGQTLVGTAIG
                |||||||||| ||||||||||||||||||||||||||||||||||||||||||| ||||
orf142ng-1      VRGFDGEMSLPAERGWYWRNDLSWQFKPGHQLYLGADVGHVSGQSAKWLSGQTLAGTAIG orf142-1.pep    IRGQIKLGGNLHYDIFTGRALKKPEFFQSRKWASGFQVGYTF
                ||||||||||||||||||||||||| ::||::|||||| :|
orf142ng-1      IRGQIKLGGNLHYDIFTGRALKKPEYFQTKKWVTGFQVGYSF
```

In addition, ORF142ng is homologous to the HecB protein of *E. chrysanthemi*:

```
gi|1772622 (L39897) HecB [Erwinia chrysanthemi] Length = 558
Score = 119 bits (295), Expect = 3e-26
Identities = 88/346 (25%), Positives = 151/346 (43%), Gaps = 22/346 (6%)

Query:   2 DNSGSEATGKYQGNITFSADNPFGLSDMFYVNYGRSIGGTPDEENFDGHRKEGGSNNYAV  61
           DNSG ++TG+ Q N + + DN FGL+D ++++ G S   +   + D   + G
Sbjct: 230 DNSGQKSTGEEQLNGSLALDNVFGLADQWFISAGHS---SRFATSHDAESLQAG------ 280

Query:  62 HYSAPFGKWTWAFNHNGYRYHQAVSGLSEVYDYNGKSYNTDFGFNRLLYRDAKRKTYLSV 121
           +S P+G W   +N++  RY        G S    F +R+++RD     KT ++
Sbjct: 281 -FSMPYGYWNLGYNYSQSRYRNTFINRDFPWHSTGDSDTHRFSLSRVVFRDGTMKTAIAG 339

Query: 122 KLWTRETKSYIDDAELTVQRRKTTGWLAELSHKGYIGRSTADFKLKYKHGTGMKDALRAP 181
           R   +Y++ + L    RK +   ++H +   A F   Y G   +
Sbjct: 340 TFSQRTGNNYLNGSLLPSSSRKLSSVSLGVNHSQKLWGGLATFNPTYNRGVRWLGSETDT 399

Query: 182 EEAFGEGTSRMKIWTASADVNTPFQIGKQLFAYDTSVHAQWNKTPLTSQDKLAIGGHHTV 241
            +++ E +   WT SA      P         Y  S++ Q++    L    ++L +GG  ++
Sbjct: 400 DKSADEPRAEFNKWTLSASYYHPV---TDSITYLGSLYGQYSARALYGSEQLTLGGESSI 456

Query: 242 RGFDGEMSLPAERGWYWRNDLSWQFKP----GHQLYLGA-DVGHVSGQSAKWLSGQTLAG 296
           RGF  E     RG YWRN+L+WQ         G+  ++ A  D  GH+       +  +L  G
Sbjct: 457 RGF-REQYTSGNRGAYWRNELNWQAWQLPVLGNVTFMAAVDGGHLYNHKQDNSTAASLWG 515

Query: 297 TAIGIRGQIKLGGNLHYDIFTGRALKKPEYFQTKKWVTGFQVGYSF              342
           A+G+        +    L    +      G + P + Q       V G++VG SF
Sbjct: 516 GAVGMTVASRW---LSQQVTGWPISYPAWLQPDTMVVGYRVGLSF              558
```

On the basis of this analysis, it is predicted that the proteins from *N. meningitidis* and *N. gonorrhoeae*, and their epitopes, could be useful antigens for vaccines or diagnostics, or for raising antibodies.

Example 73

The following partial DNA sequence was identified in *N. meningitidis* <SEQ ID 609>:

```
  1 ATGCGGACGA AATGGTCAGC AGTGAGAAGC TGCTTACTTG
    GgCGGACACC
 51 GCCGACATCG ATACCGCTTT GAACCTGTTG TACCGTTTGC
    AAAAACTCGA
101 ATTCCTCTAT GGCGATGAAA ACGGTCATTC AGACGGCATC
    AATTTGwCGG
151 ACGAGCAATT GCCGTTGCTG ATGGAACAAT TGTCCGGCAG
    CGGTAAGGCG
201 TTATTGGTCG ATCGGAACGG TCTGTATCTT GCCAACGCCA
    ATTTCCATCA
251 TGAGGCGGCG GAAGAGTTGG GGTTGTTGGC GGCAGAAGTC
    GCACAGATGG
301 AAAAGAAATA CCGGCTGCTG ATTAAGAACA AC...
```

This corresponds to the amino acid sequence <SEQ ID 610; ORF143>:

```
  1  MRTKWSAVRS CTWADTADID TALNLLYRLQ KLEFLYGDEN
     GHSDGINLXD
 51  EQLPLLMEQL SGSGKALLVD RNGLYLANAN FHHEAAEELG
     LLAAEVAQME
101  KKYRLLIKNN ...
```

Further work revealed the complete nucleotide sequence <SEQ ID 611>:

```
  1  ATGGAATCAA CACTTTCACT ACAAGCAAAT TTATATCCCC
     GCCTGACTCC
 51  TGCCGGTGCA TTTTATGCCG TATCCAGCGA TGCCCCCAGT
     GCCGGTAAAA
101  CTTTGTTGCA CAGCCTGTTG AAAGCAGATG CGGACGAAAT
     GGTCAGCAGT
```

-continued
```
151  GAGAAGCTGC TTACTTGGGC GGACACCGCC GACATCGATA
     CCGCTTTGAA
201  CCTGTTGTAC CGTTTGCAAA AACTCGAATT CCTCTATGGC
     GATGAAAACG
251  GTCATTCAGA CGGCATCAAT TTGTCGGACG AGCAATTGCC
     GTTGCTGATG
301  GAACAATTGT CCGGCAGCGG TAAGGCGTTA TTGGTCGATC
     GGAACGGTCT
351  GTATCTTGCC AACGCCAATT TCCATCATGA GGCGGCGGAA
     GAGTTGGGGT
401  TGTTGGCGGC AGAACTCGCA CAGATGGAAA AGAAATACCG
     GCTGCTGATT
451  AAGAACAACC TGTATATCAA CAATAACGCT TGGGGCGTTT
     GCGATCCTTC
501  CGGTCAGAGC GAATTGACAT TTTTCCCATT GTATATCGGT
     TCAACCAAAT
551  TTATTTTGGT TATCGGCGGC ATTCCCGATT TGGGCAAAGA
     GGCATTTGTT
601  ACTTTGCTAA GGATTTTATA CCGCCGTTAC AGCAACCGCG
     TGTAA
```

This corresponds to the amino acid sequence <SEQ ID 612; ORF143-1>:

```
  1  MESTLSLQAN LYPRLTPAGA FYAVSSDAPS AGKTLLHSLL
     KADADEMVSS
 51  EKLLTWADTA DIDTALNLLY RLQKLEFLYG DENGHSDGIN
     LSDEQLPLLM
101  EQLSGSGKAL LVDRNGLYLA NANFHHEAAE ELGLLAAEVA
     QMEKKYRLLI
151  KNNLYINNNA WGVCDPSGQS ELTFFPLYIG STKFILVIGG
     IPDLGKEAFV
201  TLVRILYRRY SNRV*
```

Computer analysis of this amino acid sequence gave the following results:

Homology with a Predicted ORF from *N. meningitidis* (Strain A)

ORF143 shows 92.4% identity over a 105aa overlap with an ORF (ORF143a) from strain A of *N. meningitidis*:

```
                                        10         20         30
orf143.pep                      MRTKWSAVRSCTWADTADIDTALNLLYRLQKLEFL
                                |: : ||||||||||||||||||||||||||
orf143a       GAFYAVSSDXPSAGKTLLHSLLKADADEMVSSEKLLTWAXTADIDTALNLLYRLQKLEFL
              20        30        40        50        60        70
                  40         50         60         70         80         90
orf143.pep    YGDENGHSDGINLXDEQLPLLMEQLSGSGKALLVDRNGLYLANANFHHEAAEELGLLAAE
              ||||||||||||| ||||||||||||||||||||||||||||||||||||||||||||||
orf143a       YGDENGHSDGINLSDEQLPLLMEQLSGSGKALLVDRNGLYLANANFHHEAAEELGLLAAE
              80        90        100       110       120       130
                  100       110
orf143.pep    VAQMEKKYRLLIKNN
              |||||||||| |||
orf143a       VAQMEKKYRLXIKNNLYINNNAWGVCDPSGQSELTFFPLYIGSTKFILVIGGIPDLGKEA
              140       150       160       170       180       190
```

The complete length ORF143a nucleotide sequence <SEQ ID 613> is:

```
  1  ATGGAATCAA CANTTTCACT ACAAGCAAAT TTATATCNCC
     GCCTGACTCC
 51  TGCCGGTGCA TTTTATGCCG TATCCAGCGA TGNCCCCAGT
     GCCGGTAAAA
101  CTTTGTTGCA CAGCCTGTTG AAAGCGGATG CGGACGAAAT
     GGTNAGCAGT
151  GAGAAGCTGC TTACCTGGGC GGANACCGCC GACATCGATA
     CCGCTTTGAA
201  CCTGTTGTAC CGTTTGCAAA AACTCGAATT CCTCTATGGC
     GATGAAAACG
251  GTCATTCAGA CGGCATCAAT TTGTCGGACG AGCAATTGCC
     GTTGCTGATG
301  GAACAATTGT CCGGCAGCGG TAAGGCGTTA TTGGTCGATC
     GGAACGGTCT
351  GTATCTTGCC AACGCCAATT TCCATCATGA GGCGGCGGAA
     GAGTTGGGGT
401  TGTTGGCGGC AGAAGTCGCA CAGATGGAAA AGAAATACCG
     GCTGCNNATT
451  AAGAACAACC TGTATATCAA CAATAACGCT TGGGGCGTTT
     GCGATCCTTC
```

```
501  CGGTCAGAGC GAATTGACAT TTTTCCCATT GTATATCGGT
     TCAACCAAAT

551  TTATTTTGGT TATCGGCGGC ATTCCCGATT TGGGCAAAGA
     GGCATTTGTT

601  ACTTTGGTAA GGATNTTATA CCNCCNGTTA CAGCAACCGC
     GTGTAAAACT

651  TGGGAGAGAG GANGGGTTAT GCAGCAATTA TTGA
```

This encodes a protein having amino acid sequence <SEQ ID 614>:

```
  1  MESTXSLQAN LYXRLTPAGA FYAVSSDXPS AGKTLLHSLL
     KADADEMVSS

51  EKLLTWAXTA DIDTALNLLY RLQKLEFLYG DENGHSDGIN
     LSDEQLPLLM

101  EQLSGSGKAL LVDRNGLYLA NANFHHEAAE ELGLLAAEVA
     QMEKKYRLXI

151  KNNLYINNNA WGVCDPSGQS ELTFFPLYIG STKFILVIGG
     IPDLGKEAFV

201  TLVRXLYXXL QQPRVKLGRE XGLCSNY*
```

ORF143a and ORF143-1 show 97.1% identity in 207 aa overlap:

```
orf143a.pep  MESTXSLQANLYXRLTPAGAFYAVSSDXPSAGKTLLHSLLKADADEMVSSEKLLTWAXTA
             ||||  ||||||| ||||||||||||| ||||||||||||||||||||||||||||| ||
orf143-1     MESTLSLQANLYPRLTPAGAFYAVSSDAPSAGKTLLHSLLKADADEMVSSEKLLTWADTA orf143a.pep  DIDTALNLLYRLQKLEFLYGDENGHSDGINLSDEQLPLLMEQLSGSGKALLVDRNGLYLA
             ||||||||||||||||||||||||||||||||||||||||||||||||||||||||||||
orf143-1     DIDTALNLLYRLQKLEFLYGDENGHSDGINLSDEQLPLLMEQLSGSGKALLVDRNGLYLA orf143a.pep  NANFHHEAAEELGLLAAEVAQMEKKYRLXIKNNLYINNNAWGVCDPSGQSELTFFPLYIG
             ||||||||||||||||||||||||||| ||||||||||||||||||||||||||||||||
orf143-1     NANFHHEAAEELGLLAAEVAQMEKKYRLLIKNNLYINNNAWGVCDPSGQSELTFFPLYIG orf143a.pep  STKFILVIGGIPDLGKEAFVTLVRXLY
             |||||||||||||||||||||||| ||
orf143-1     STKFILVIGGIPDLGKEAFVTLVRILY
```

Homology with a Predicted ORF from *N. gonorrhoeae*

ORF143 shows 95.5% identity over a 110aa overlap with a predicted ORF (ORF143ng) from *N. gonorrhoeae*:

```
orf143a.pep  MRTKWSAVRSCTWADTADIDTALNLLYRLQKLEFLYGDENGHSDGINLXDEQLPLLMEQL  60
             |||||||||||:|||||||||||||||||||||||||||||||||||||| |||||||||
orf143ng     MRTKWSAVRSCSRADTADIDTALNLLYRLQKLEFLYGDENGHSDGINLSDEQLPLLMEQL  60 orf143a.pep  SGSGKALLVDRNGLYLANANFHHEAAEELGLLAAEVAQMEKKYRLLIKNN           110
             |||||||||||||||||||||||| :||||||||||||||||||||:||
orf143ng     SGSGKALLVDRNGLYLANANFHHESAEELGLLAAEVAQMEKKYRLLIRNNLYINNNAWGV 120
```

An ORF143ng nucleotide sequence <SEQ ID 615> was predicted to encode a protein having amino acid sequence <SEQ ID 616>:

```
  1  MRTKWSAVRS CSRADTADID TALNLLYRLQ KLEFLYGDEN
     GHSDGINLSD

51  EQLPLLMEQL SGSGKALLVD RNGLYLANAN FHHESAEELG
     LLAAEVAQME
```

```
101  KKYRLLIRNN LYINNNAWGV CDPSGQSELT FFPLYIGSTK
     FILVIAGIPD

151  LSKGGICYFG KDFIPPLQQP RVKLGTGGIM RQLLISILED
     LNNTSTDIIA

201  SAVISTDGLP MATMLPSHLN SDRVGAISAT LLALGSRSVQ
     ELACGELEQV

251  MIKGKSGYIL LSQAGKDAVL VLVAKETGRL GLILLDAKRA
     ARHIAEAI*
```

Further work revealed the following gonococcal DNA sequence <SEQ ID 617>:

```
  1  ATGGAATCAA CACTTTCACT ACAAGCGAAT TTATATCCCT
     GCCTGACTCC

51  TGCCGGTGCA TTTTATGCCG TATCCAGCGA TGCCCCCAGT
     GCCGGTAAAA

101  CTTTGTTGCG CAGCCTGTTG AAAGCGGATG CGGACGAAGT
     GGTCAGCAGT

151  GAGAAGCTGC TCGCGGCGGA CACCGCCGAC ATCGATACCG
     CTTTGAACCT

201  GTTGTACCGT TTGCAAAAAC TCGAATTCCT CTATGGCGAT
     GAAAACGGTC
```

```
251  ATTCAGACGG CATCAATTTG TCGGACGAGC AATTGCCGTT
     GCTGATGGAA

301  CAATTGTCCG GCAGCGGTAA GGCATTATTG GTCGATCGGA
     ACGGTCTGTA

351  TCTTGCCAAC GCCAATTTCC ATCATGAGTC GGCGGAAGAG
     TTGGGGTTGT
```

```
401 TGGCGGCAGA AGTCGCACAG ATGGAAAAGA AATACCGGCT
    GCTGATTAGG

451 AACAACCTGT ATATCAACAA TAACGCTTGG GGCGTTTGCG
    ATCCTTCCGG

501 TCAGAGCGAA TTGACATTTT TCCCATTGTA TATCGGTTCA
    ACCAAATTTA

551 TTTTGGTTAT CGCCGGCATT CCCGATTTGA GCAAAGAGGC
    ATTTGTTACT

601 TTGGTAAGGA TTTTATACCG CCGTTACAGC AACCGCGTGT
    AA
```

This corresponds to the amino acid sequence <SEQ ID 618; ORF143ng-1>:

```
  1 MESTLSLQAN LYPCLTPAGA FYAVSSDAPS AGKTLLRSLL
    KADADEVVSS

51 EKLLAADTAD IDTALNLLYR LQKLEFLYGD ENGHSDGINL
    SDEQLPLLME

101 QLSGSGKALL VDRNGLYLAN ANFHHESAEE LGLLAAEVAQ
    MEKKYRLLIR

151 NNLYINNNAW GVCDPSGQSE LTFFPLYIGS TKFILVIAGI
    PDLSKEAFVT

201 LVRILYRRYS NRV*
```

ORF143ng-1 and ORF143-1 show 95.8% identity in 214 aa overlap:

```
orf143ng-1.pep  MESTLSLQANLYPCLTPAGAFYAVSSDAPSAGKTLLRSLLKADADEVVSSEKLLA-ADTA    59
                ||||||||||||| |||||||||||||||||||||||:||||||||:||||||: ||||
orf143-1        MESTLSLQANLYPRLTPAGAFYAVSSDAPSAGKTLLHSLLKADADEMVSSEKLLTWADTA    60
orf143ng-1.pep  DIDTALNLLYRLQKLEFLYGDENGHSDGINLSDEQLPLLMEQLSGSGKALLVDRNGLYLA   119
                ||||||||||||||||||||||||||||||||||||||||||||||||||||||||||||
orf143-1        DIDTALNLLYRLQKLEFLYGDENGHSDGINLSDEQLPLLMEQLSGSGKALLVDRNGLYLA   120
orf143ng-1.pep  NANFHHESAEELGLLAAEVAQMEKKYRLLIRNNLYINNNAWGVCDPSGQSELTFFPLYIG   179
                |||||||:||||||||||||||||||||||:|||||||||||||||||||||||||||||
orf143-1        NANFHHEAAEELGLLAAEVAQMEKKYRLLIKNNLYINNNAWGVCDPSGQSELTFFPLYIG   180
orf143ng-1.pep  STKFILVIAGIPDLSKEAFVTLVRILYRRYSNRV   213
                ||||||||:|||||:||||||||||||||||||
orf143-1        STKFILVIGGIPDLGKEAFVTLVRILYRRYSNRV   214
```

Based on the presence of the putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 74

The following partial DNA sequence was identified in *N. meningitidis* <SEQ ID 619>:

```
  1 ATGACCTTTT TACAACGTTT GCAAGGTTTG GCAGACAATA
    AAATCTGTGC

51 GTTTGCATGG TTCGTCGTCC GCCGCTTTGA TGAAGAACGC
    GTACCGCAGr

101 CGGCGGCAAG CATGACGTTT ACGACGCTGC TGGCACTCGT
    CCCCGTGCTG

151 ACCGTGATGG TGGCGGTCGC TTCGATTTTC CCCGTGTTCG
    ACCGCTGGTC

201 GGATTCGTTC GTCTCCTTCG TCAACCAAAC CATTGTGCCG
    CA.GGCGCGG

251 ACATGGTGTT CGACTATATC AATGCGTTCC GCGAGCAGGC
    GAACCGGCTG

301 ACGGCAATCG GCAGCGTGAT GCTGGTCGTT ACCTCGCTGA
    TGCTGATTCG

351 GACGATAGAC AATACGTTCA ACCGCATCTG GaCGGGTCAA
    wTyCCAGCGT

401 CCGTGGATG...
```

This corresponds to the amino acid sequence <SEQ ID 620; ORF144>:

```
  1 MTFLQRLQGL ADNKICAFAW FVVRRFDEER VPQXAASMTF
    TTLLALVPVL

51 TVMVAVASIF PVFDRWSDSF VSFVNQTIVP XGADMVFDYI
    NAFREQANRL

101 TAIGSVMLVV TSLMLIRTID NTFNRIWRVX XQRPWM...
```

Further work revealed the complete nucleotide sequence <SEQ ID 621>:

```
  1 ATGACCTTTT TACAACGTTT GCAAGGTTTG GCAGACAATA
    AAATCTGTGC

51 GTTTGCATGG TTCGTCGTCC GCCGCTTTGA TGAAGAACGC
    GTACCGCAGG

101 CGGCGGCAAG CATGACGTTT ACGACGCTGC TGGCACTCGT
    CCCCGTGCTG

151 ACCGTGATGG TGGCGGTCGC TTCGATTTTC CCCGTGTTCG
    ACCGCTGGTC

201 GGATTCGTTC GTCTCCTTCG TCAACCAAAC CATTGTGCCG
    CAGGGCGCGG

251 ACATGGTGTT CGACTATATC AATGCGTTCC GCGAGCAGGC
    GAACCGGCTG

301 ACGGCAATCG GCAGCGTGAT GCTGGTCGTT ACCTCGCTGA
    TGCTGATTCG
```

-continued

```
351 GACGATAGAC AATACGTTCA ACCGCATCTG GCGGGTCAAT
    TCCCAGCGTC

401 CGTGGATGAT GCAGTTTCTC GTCTATTGGG CTTTACTGAC
    GTTCGGGCCG

451 CTGTCTTTGG GCGTGGGCAT TTCCTTTATG GTCGGCTCGG
    TACAGGATGC

501 CGCGCTTGCC TCAGGTGCGC CGCAGTGGTC GGGCGCGTTG
    CGAACGGCGG

551 CGACGCTGAC CTTCATGACG CTTTTCCTGT GGGGGCTGTA
    CCGCTTCGTG

601 CCAAACCGCT TCGTTCCCGC GCGGCAGGCG TTTGTCGGGG
    CTTTGGCAAC

651 AGCGTTTTGT CTGGAAACCG CGCGCTCCCT CTTCACTTGG
    TATATGGGCA

701 ATTTCGACGG CTACCGCTCG ATTTACGGCG CGTTTGCCGC
    CGTGCCGTTT

751 TTTCTGTTGT GGCTGAACCT GTTGTGGACG CTGGTCTTGG
    GCGGCGCGGT

801 GCTGACTTCT TCACTCTCCT ACTGGCAGGG AGAAGCGTTC
    CGCAGGGGCT

851 TCGACTCGGG CGGACGGTTT GACGACGTGT TGAAAATCCT
    GCTGCTTCTG

901 GATGCGGCGC AAAAAGAAGG CAAAGCCTTG CCTGTTCAGG
    AGTTCAGACG

951 GCATATCAAT ATGGGCTACG ACGAGTTGGG CGAGCTTTTG
    GAAAAGCTGG

1001 CGCGGCACGG CTACATCTAT TCCGGCAGAC AGGGTTGGGT
     GTTGAAAACG

1051 GGGGCGGATT CGATTCAGTT GAACGAACTC TTCAAGCTCT
     TCGTTTACCG
```

-continued

```
1101 TCCGTTGCCT GTGGAAAGGG ATCATGTGAA CCAAGCTGTC
     GATGCGGTAA

1151 TGACACCGTG TTTGCAGACT TTGAACATGA CGCTGGCACA
     GTTTGACGCT

1201 CAGGCGAAAA AACGGCAGTA G
```

This corresponds to the amino acid sequence <SEQ ID 622; ORF144-1>:

```
  1 MTFLQRLQGL ADNKICAFAW FVVRRFDEER VPQAAASMTF
    TTLLALVPVL

51 TVMVAVASIF PVFDRWSDSF VSFVNQTIVP QGADMVFDYI
    NAFREQANRL

101 TAIGSVMLVV TSLMLIRTID NTFNRIWRVN SQRPWMMQFL
    VYWALLTFGP

151 LSLGVGISFM VGSVQDAALA SGAPQWSGAL RTAATLTFMT
    LLLWGLYRFV

201 PNRFVPARQA FVGALATAFC LETARSLFTW YMGNFDGYRS
    IYGAFAAVPF

251 FLLWLNLLWT LVLGGAVLTS SLSYWQGEAF RRGFDSRGRF
    DDVLKILLLL

301 DAAQKEGKAL PVQEFRRHIN MGYDELGELL EKLARHGYIY
    SCRQGWVLKT

351 GADSIELNEL FKLFVYRPLP VERDHVNQAV DAVMTPCLQT
    LNMTLAEFDA

401 QAKKRQ*
```

Computer analysis of this amino acid sequence gave the following results:

Homology with a Predicted ORF from *N. meningitidis* (Strain A)

ORF144 shows 96.3% identity over a 136aa overlap with an ORF (ORF144a) from strain A of *N. meningitidis*:

```
                     10        20        30        40        50        60
orf144.pep   MTFLQRLQGLADNKICAFAWFVVRRFDEERVPQXAASMTFTTLLALVPVLTVMVAVASIF
             |||||||||||||||||||||||||||||||||| |||||||||||||||||||||||||
orf144a      MTFLQRLQGLADNKICAFAWFVVRRFDEERVPQAAASMTFTTLLALVPVLTVMVAVASIF
                     10        20        30        40        50        60

70        80        90       100       110       120
orf144.pep   PVFDRWSDSFVSFVNQTIVPXGADMVFDYINAFREQANRLTAIGSVMLVVTSLMLIRTID
             |||||||||||||||||||| ||||||||||||||||||||||||||||||| |||||||
orf144a      PVFDRWSDSFVSFVNQTIVPQGADMVFDYINAFREQANRLTAIGSVMLVVTSXMLIRTID
                     70        80        90       100       110       120

130
orf144.pep   NTFNRIWRVXXQRPWM
             ||||||||||  |||||
orf144a      NTFNRIWRVNSQRPWMMQFLVYWALLTFGPLSLGVGISFXVGSVQDAALASGAPQWSGAL
                    130       140       150       160       170       180
```

The complete length ORF144a nucleotide sequence <SEQ ID 623> is:

```
   1 ATGACCTTTT TACAACGTTT GCAAGGTTTG GCAGACAATA
     AAATCTGTGC
  51 GTTTGCATGG TTCGTCGTCC GCCGCTTTGA TGAAGAACGC
     GTACCGCAGG
 101 CGGCGGCAAG CATGACGTTT ACGACACTGC TGGCACTCGT
     CCCCGTGCTG
 151 ACCGTGATGG TGGCGGTCGC TTCGATTTTC CCCGTGTTCG
     ACCGNTGGTC
 201 GGATTCGTTC GTCTCCTTCG TCAACCAAAC CATTGTGCCG
     CAGGGCGCGG
 251 ACATGGTNTT CGACTATATC AATGCGTTCC GCGAGCAGGC
     GAACCGGCTG
 301 ACGGCAATCG GCAGCGTGAT GCTGGTCGTT ACCTCGCNGA
     TGCTGATTCG
 351 GACGATAGAC AATACGTTCA ACCGCATCTG GCGGGTCAAT
     TCCCAGCGTC
 401 CGTGGATGAT GCAGTTTCTC GTCTATTGGG CTTTACTGAC
     GTTCGGGCCG
 451 CTGTCTTTGG GCGTGGGCAT TTCCTTTATN GTCGGCTCGG
     TACAGGATGC
 501 CGCGCTTGCC TCAGGTGCGC CGCAGTGGTC GGGCGCGTTG
     CGAACGGCGG
 551 CGACGCTGAN CTTCATGACG CTTTTGCTGT GGGGCTGTA
     CCGCTNCGTG
 601 CCAAACCGCT TCGTTCCCGC GCGGCANGCG TTTGTCGGGG
     CTTTGGCAAC
 651 AGCGTTCTGT CTGGAAACCG CGCGTTCCCT CTTTACTTGG
     TATATGGGCA
 701 ATTTCGACGG CTACCGCTCG ATTTACGGNG CGTTTGCCGC
     CGTGCCGTTT
 751 TTTCTGTTGT GGCTGAACCT GTTGTGGACG CTGGTCTTGG
     GCGGCGCGGT
 801 GCTGACTTCT TCACTCTCCT ACTGGCAGGG AGAAGCGTTC
     CGCAGGGNCT
 851 TCGACTCGCG CGGACGGTTT GACGACGTGT TGAAAATCCT
     GCTGCTTCTG
 901 GATGCGGCGC AAAAAGAAGG CNAAGCCTTG CCTGTTCAGG
     AGTTCAGACG
 951 GCATATCAAT ATGGGCTACG ACGAGTTGGG CGAGCTTTTG
     GAAAAGCTGG
1001 CGCGGCACGG CTACATCTAT TCCGGCAGAC AGGGTTGGGT
     GTTGAAAACG
1051 GGGGCGGATT CGATTGAGTT GAACGAACTC TTCAAGCTCT
     TCGTTTACCG
1101 TCCGTTGCCT GTGGAAAGGG ATCATGTGAA CCAAGCTGTC
     GATGCGGTAA
1151 TGATGCCGTG TTTGCAGACT TTGAACATGA CGCTGGCAGA
     GTTTGACGCT
1201 CAGGCGAAAA AACAGCAGCA ATCTTGA
```

This encodes a protein having amino acid sequence <SEQ ID 624>:

```
  1 MTFLQRLQGL ADNKICAFAW FVVRRFDEER VPQAAASMTF
    TTLLALVPVL
 51 TVMVAVASIF PVFDRWSDSF VSFVNQTIVP QGADMVFDYI
    NAFREQANRL
101 TAIGSVMLVV TSXMLIRTID NTFNRIWRVN SQRPWMMQFL
    VYWALLTFGP
151 LSLGVGISFX VGSVQDAALA SGAPQWSGAL RTAATLXFMT
    LLLWGLYRXV
201 PNRFVPARXA FVGALATAFC LETARSLFTW YMGNFDGYRS
    IYGAFAAVPF
251 FLLWLNLLWT LVLGGAVLTS SLSYWQGEAF RRXFDSRGRF
    DDVLKILLLL
301 DAAQKEGXAL PVQEFRRHIN MGYDELGELL EKLARHGYIY
    SGRQGWVLKT
351 GA0SIELNEL FKLFVYRPLP VERDHVNQAV DAVMMPCLQT
    LNMTLAEFDA
401 QAKKQQQS*
```

ORF144a and ORF144-1 show 97.8% identity in 406 aa overlap:

```
orf144a.pep  MTFLQRLQGLADNKICAFAWFVVRRFDEERVPQAAASMTFTTLLALVPVLTVMVAVASIF
             ||||||||||||||||||||||||||||||||||||||||||||||||||||||||||||
orf144-1     MTFLQRLQGLADNKICAFAWFVVRRFDEERVPQAAASMTFTTLLALVPVLTVMVAVASIF orf144a.pep  PVFDRWSDSFVSFVNQTIVPQGADMVFDYINAFREQANRLTAIGSVMLVVTSXMLIRTID
             |||||||||||||||||||||||||||||||||||||||||||||||||||| ||||||
orf144-1     PVFDRWSDSFVSFVNQTIVPQGADMVFDYINAFREQANRLTAIGSVMLVVTSLMLIRTID orf144a.pep  NTFNRIWRVNSQRPWMMQFLVYWALLTFGPLSLGVGISFXVGSVQDAALASGAPQWSGAL
             |||||||||||||||||||||||||||||||||||||||||||||||||||||||||||
orf144-1     NTFNRIWRVNSQRPWMMQFLVYWALLTFGPLSLGVGISFMVGSVQDAALASGAPQWSGAL
```

```
orf144a.pep  RTAATLXFMTLLLWGLYRXVPNRFVPARXAFVGALATAFCLETARSLFTWYMGNFDGYRS
             ||||||:||||||||||||||||||| ||||||||||||||||||||||||||||||||
orf144-1     RTAATLTFMTLLLWGLYRFVPNRFVPARQAFVGALATAFCLETARSLFTWYMGNFDGYRS orf144a.pep  IYGAFAAVPFFLLWLNLLWTLVLGGAVLTSSLSYWQGEAFRRXFDSRGRFDDVLKILLLL
             ||||||||||||||||||||||||||||||||||||||||||| ||||||||||||||||
orf144-1     IYGAFAAVPFFLLWLNLLWTLVLGGAVLTSSLSYWQGEAFRRGFDSRGRFDDVLKILLLL orf144a.pep  DAAQKEGXALPVQEFRRHINMGYDELGELLEKLARHGYIYSGRQGWVLKTGADSIELNEL
             |||||| ||||||||||||||||||||||||||||||||||||||||||||||||||||
orf144-1     DAAQKEGKALPVQEFRRHINMGYDELGELLEKLARHGYIYSGRQGWVLKTGADSIELNEL orf144a.pep  FKLFVYRPLPVERDHVNQAVDAVMMPCLQTLNMTLAEFDAQAKKQQQS      408
             |||||||||||||||||||||||||| |||||||||||||||||||:|
orf144-1     FKLFVYRPLPVERDHVNQAVDAVMTPCLQTLNMTLAEFDAQAKKRQ        406
```

Homology with a Predicted ORF from *N. gonorrhoeae*
ORF144 shows 91.2% identity over a 136aa overlap with a predicted ORF (ORF144ng) from *N. gonorrhoeae*:

```
orf144.pep   MTFLQRLQGLADNKICAFAWFVVRRFDEERVPQXAASMTFTTLLALVPVLTVMVAVASIF    60
             |||||  || ||||||||||||:|||:||||||||||||||||||||||||||||||||
orf144ng     MTFLQCWQGSADNKICAFAWFVIRRFSEERVPQAAASMTFTTLLALVPVLTVMVAVASIF    60
orf144.pep   PVFDRWSDSFVSFVNQTIVPXGADMVFDYINAFREQANRLTAIGSVMLVVTSLMLIRTID   120
             |||||||||||||||||||| |||||||||:|||:|||||||||||||||||||||||||
orf144ng     PVFDRWSDSFVSFVNQTIVPQGADMVFDYIDAFRDQANRLTAIGSVMLVVTSLMLIRTID   120
orf144.pep   NTFNRIWRVXXQRPWM                                               136
             |:|||||||  :||||
orf144ng     NAFNRIWRVNTQRPWMMQFLVYWALLTFGPLSLGVGISFMVGSVQDSVLSSGAQQWADAL   180
```

The complete length ORF144ng nucleotide sequence <SEQ ID 625> is predicted to encode a protein having amino acid sequence <SEQ ID 626>:

```
  1 MTFLQCWQGS ADNKICAFAW FVIRRFSEER VPQAAASMTF
    TTLLALVPVL
 51 TVMVAVASIF PVFDRWSDSF VSFVNQTIVP QGADMVFDYI
    DAFRDQANRL
101 TAIGSVMLVV TSLMLIRTID NAFNRIWRVN TQRPWMMQFL
    VYWALLTFGP
151 LSLGVGISFM VGSVQDSVLS SGAQQWADAL KTAARLAFMT
    LLLWGLYRFV
201 PNRFVPARQA FVGALITAFC LETARFLFTW YMGNFDGYRS
    IYGAFAAVPF
251 FLLWLNLLWT LVLGGAVLTS SLSYWQGEAF RRGFDSRGRF
    DDVLKILLLL
301 DAAQKEGRTL SVQEFRRHIN MGYDELGELL EKLARYGYIY
    SGRQGWVLKT
351 GADSIELSEL FKLFVYRPLP VERDHVNQAV DAVMTPCLQT
    LNMTLAEFDA
401 QAKKQQQS*
```

Further work revealed the following gonococcal DNA sequence <SEQ ID 627>:

```
  1 ATGACCTTTT TACAACGTTG GCAAGGTTTG GCGGACAATA
    AAATCTGTGC
 51 ATTTGCATGG TTCGTCATCC GCCGTTTCAG TGAAGAGCGC
    GTACCGCAGG
101 CAGCGGCGAG CATGACGTTT ACGACACTGC TGGCACTCGT
    CCCCGTACTG
151 ACCGTAATGG TCGCGGTCGC TTCGATTTTC CCCGTGTTCG
    ACCGCTGGTC
201 GGATTCGTTC GTCTCCTTCG TCAACCAAAC CATTGTGCCG
    CAGGGCGCGG
251 ATATGGTGTT CGACTATATC GACGCATTCC GCGATCAGGC
    AAACCGGCTG
301 ACCGCCATCG GCAGCGTGAT GCTGGTCGTA ACCTCGCTGA
    TGCTGATTCG
351 GACGATAGAC AATGCGTTCA ACCGCATCTG GCGGGTTAAC
    ACGCAACGCC
401 CCTGGATGAT GCAGTTCCTC GTTTATTGGG CGTTGCTGAC
    TTTCGGGCCT
451 TTGTCTTTGG GTGTGGGCAT TCCTTTATG GTCGGGTCGG
    TTCAAGACTC
501 CGTACTCTCC TCCGGAGCGC AACAATGGGC GGACGCGTTG
    AAGACGGCGG
551 CAAGGCTGGC TTTCATGACG CTTTTGCTGT GGGGGCTGTA
    CCGCTTCGTG
601 CCCAACCGCT TCGTGCCCGC CCGGCAGGCG TTTGTCGGAG
    CTTTGATTAC
```

```
651 GCCATTCTGC CTGGAGACGG CACGTTTCCT GTTCACCTGG
    TATATGGGCA

701 ATTTCGACGG CTACCGCTCG ATTTACGCCG CATTTGCCGC
    CGTGCCGTTT

751 TTCCTGCTGT GGTTAAACCT GCTGTGGACG CTGGTCTTGG
    GCGGGGCGGT

801 GCTGACTTCG TCGCTGTCTT ATTGGCAGGG CGAGGCCTTC
    CGCAGGGGAT

851 TCGACTCGCG CGGACGGTTT GACGACGTGT TGAAAATCCT
    GCTGCTTCTG

901 GATGCGGCGC AAAAGAAGG CCGAACCCTG TCCGTTCAGG
    AGTTCAGACG

951 GCATATCAAT ATGGGTTACG ATGAATTGGG CGAGCTTTTG
    GAAAAGCTGG
```

```
-continued
1001 CGCGGTACGG CTATATCTAT TCCGGCAGAC AGGGCTGGGT
     TTTGAAAACG

1051 GGGGCGGATT CGATTGAGTT GAGCGAACTC TTCAAGCTCT
     TCGTGTACCG

1101 CCCGTTGCct gtggaAAGGG ATCATGTGAA CCAAGCTGtc
     gaTGCGGTAA

1151 TGAcgccgtG TTTGCAGACT TTGAACATGA CGCTGGCGGA
     GTTTGACGCT

1201 CAGgcgAAAA AACAGCAGCA GTCTTGA
```

This encodes a variant of ORF144ng, having the amino acid sequence <SEQ ID 628; ORF144ng-1>:

```
  1 MTFLQRWQGL ADNKICAFAW FVIRRFSEER VPQAAASMTF
    TTLLALVPVL

51 TVMVAVASIF PVFDRWSDSF VSFVNQTIVP QGADMVFDYI
    DAFRDQANRL
```

```
-continued
101 TAIGSVMLVV TSLMLIRTID NAFNRIWRVN TQRPWMMQFL
    VYWALLTFGP

151 LSLGVGISFM VGSVQDSVLS SGAQQWADAL KTAARLAFMT
    LLLWGLYRFV

201 PNRFVPARQA FVGALITAFC LETARFLFTW YMGNFDGYRS
    IYGAFAAVPF

251 FLLWLNLLWT LVLGGAVLTS SLSYWQGEAF RRGFDSRGRF
    DDVLKILLLL

301 DAAQKEGRTL SVQEFRRHIN MGYDELGELL EKLARYGYIY
    SGRQGWVLKT

351 GADSIELSEL FKLFVYRPLP VERDHVNQAV DAVMTPCLQT
    LNMTLAEFDA

401 QAKKQQQS*
```

ORF144ng-1 and ORF144-1 show 94.1% identity in 406 aa overlap:

```
orf144ng-1.pep    MTFLQRWQGLADNKICAFAWFVIRRFSEERVPQAAASMTFTTLLALVPVLTVMVAVASIF
                  |||||  |||||||||||||||| |||:||||||||||||||||||||||||||||||||
orf144-1          MTFLQRLQGLADNKICAFAWFVVRRFDEERVPQAAASMTFTTLLALVPVLTVMVAVASIF orf144ng-1.pep    PVFDRWSDSFVSFVNQTIVPQGADMVFDYIDAFRDQANRLTAIGSVMLVVTSLMLIRTID
                  ||||||||||||||||||||||||||||||:|||:|||||||||||||||||||||||||
orf144-1          PVFDRWSDSFVSFVNQTIVPQGADMVFDYINAFREQANRLTAIGSVMLVVTSLMLIRTID orf144ng-1.pep    NAFNRIWRVNTQRPWMMQFLVYWALLTFGPLSLGVGISFMVGSVQDSVLSSGAQQWADAL
                  |:||||||||:|||||||||||||||||||||||||||||||||||| ::|:||  || ||
orf144-1          NTFNRIWRVNSQRPWMMQFLVYWALLTFGPLSLGVGISFMVGSVQDAALASGAPQWSGAL orf144ng-1.pep    KTAARLAFMTLLLWGLYRFVPNRFVPARQAFVGALITAFCLETARFLFTWYMGNFDGYRS
                  :||| |:|||||||||||||||||||||||||||||||| |||||:|||||||||||||
orf144-1          RTAATLTFMTLLLWGLYRFVPNRFVPARQAFVGALATAFCLETARSLFTWYMGNFDGYRS orf144ng-1.pep    IYGAFAAVPFFLLWLNLLWTLVLGGAVLTSSLSYWQGEAFRRGFDSRGRFDDVLKILLLL
                  ||||||||||||||||||||||||||||||||||||||||||||||||||||||||||||
orf144-1          IYGAFAAVPFFLLWLNLLWTLVLGGAVLTSSLSYWQGEAFRRGFDSRGRFDDVLKILLLL orf144ng-1.pep    DAAQKEGRTLSVQEFRRHINMGYDELGELLEKLARYGYIYSGRQGWVLKTGADSIELSEL
                  ||||||::| |||||||||||||||||||||||||:||||||||||||||||||||||:||
orf144-1          DAAQKEGKALPVQEFRRHINMGYDELGELLEKLARHGYIYSGRQGWVLKTGADSIELNEL orf144ng-1.pep    FKLFVYRPLPVERDHVNQAVDAVMTPCLQTLNMTLAEFDAQAKKQQQS
                  ||||||||||||||||||||||||||||||||||||||||||||:|
orf144-1          FKLFVYRPLPVERDHVNQAVDAVMTPCLQTLNMTLAEFDAQAKKRQ
```

On this basis of this analysis, including the identification of several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 75

The following partial DNA sequence was identified in *N. meningitidis* <SEQ ID 629>:

```
  1 ...AGACACGCCC GCCGCATCCG CATCGACACC GCCATCAACC
     CCGAACTGGA

51 AGCCCTCGCC GAACACCTCC ACTACCAATG GCACGGCTTC
    CTCTGGCTCA

101 GCACCGATAT GCGTCAGGAA ATTTCCGCCC TCGTCATCCT
    GCTGCAACGC
```

-continued

```
151  ACCCGCCGCA AATGGCTGGA TGCCCACGAA CGCCAACACC
     TGCGCCAAAG

201  CCTGCTTGAA ACACGGGAAC ACGGCTGA
```

This corresponds to the amino acid sequence <SEQ ID 630; ORF146>:

```
  1  . . . RHARRIRIDT AINPELEALA EHLHYQWQGF
         LWLSTDMRQE ISALVILLQR

51  TRRKWLDAHE RQHLRQSLLE TREHG*
```

Further work revealed the complete nucleotide sequence <SEQ ID 631>:

```
  1  ATGAACACCT CGCAACGCAA CCGCCTCGTC AGCCGCTGGC
     TCAACTCCTA

51  CGAACGCTAC CGCTACCGCC GCCTCATCCA CGCCGTCCGG
     CTCGGCGGGG

101  CCGTCCTGTT CGCCACCGCC TCCGCCCGGC TGCTCCACCT
     CCAACACGGC

151  GAGTGGATAG GGATGACCGT CTTCGTCGTC CTCGGCATGC
     TCCAGTTTCA

201  AGGGGCGATT TACTCCAAGG CGGTGGAACG TATGCTCGGC
     ACGGTCATCG

251  GGCTGGGCGC GGGTTTGGGC GTTTTATGGC TGAACCAGCA
     TTATTTCCAC

301  CGCAACCTCC TCTTCTACCT CACCGTCGGC ACGGCAAGCG
     CACTGGCCGG

351  CTGGGCGGCG GTCGGCAAAA ACGGCTACGT CCCTATGCTG
     GCAGGGCTGA

401  CGATGTGTAT GCTCATCGGC GACAACGGCA GCGAATGGCT
     CGACAGCGGA

451  CTCATGCGCG CCATGAACGT CCTCATCGGC GCGGCCATCG
     CCATCGCCGC

501  CGCCAAACTG CTGCCGCTGA AATCCACACT GATGTGGCGT
     TTCATGCTTG

551  CCGACAACCT GGCCGACTGC AGCAAAATGA TTGCCGAAAT
     CAGCAACGGC

601  AGGCGCATGA CCCGCGAACG CCTCGAGGAG AACATGGCGA
     AAATGCGCCA

651  AATCAACGCA CGCATGGTCA AAAGCCGCAG CCATCTCGCC
     GCCACATCGG
```

```
701  GCGAAAGCCG CATCAGCCCC GCCATGATGG AAGCCATGCA
     GCACGCCCAC

751  CGTAAAATCG TCAACACCAC CGAGCTGCTC CTGACCACCG
     CCGCCAAGCT

801  GCAATCTCCC AAACTCAACG GCAGCGAAAT CCGGCTGCTT
     GACCGCCACT

851  TCACACTGCT CCAAACCGAC CTGCAACAAA CCGTCGCCCT
     TATCAACGGC

901  AGACACGCCC GCCGCATCCG CATCGACACC GCCATCAACC
     CCGAACTGGA

951  AGCCCTCGCC GAACACCTCC ACTACCAATG GCAGGGCTTC
     CTCTGGCTCA

1001 GCACCAATAT GCGTCAGGAA ATTTCCGCCC TCGTCATCCT
     GCTGCAACGC

1051 ACCCGCCGCA AATGGCTGGA TGCCCACGAA CGCCAACACC
     TGCGCCAAAG

1101 CCTGCTTGAA ACACGGGAAC ACGGCTGA
```

This corresponds to the amino acid sequence <SEQ ID 632; ORF146-1>:

```
  1  MNTSQRNRLV SRWLNSYERY RYRRLIHAVR LGGAVLFATA
     SARLLHLQHG

51  EWIGMTVFVV LGMLQFQGAI YSKAVERMLG TVIGLGAGLG
     VLWLNQHYFH

101  GNLLFYLTVG TASALAGWAA VGKNGYVPML AGLTMCMLIG
     DNGSEWLDSG

151  LMRAMNVLIG AAIAIAAAKL LPLKSTLMWR FMLADNLADC
     SKMIAEISNG

201  RRMTRERLEE NMAKMRQINA RMVKSRSHLA ATSGESRISP
     ANMEAMQHAH

251  RKIVNTTELL LTTAAKLQSP KLNGSEIRLL DRHFTLLQTD
     LQQTVALING

301  RHARRIRIDT AINPELEALA EHLHYQWQGF LWLSTNMRQE
     ISALVILLQR

351  TRRKWLDAHE RQHLRQSLLE TREHG*
```

Computer analysis of this amino acid sequence gave the following results:

Homology with a Predicted ORF from *N. meningitidis* (Strain A)

ORF146 shows 98.6% identity over a 74aa overlap with an ORF (ORF146a) from strain A of *N. meningitidis*:

```
                              10         20         30
orf146.pep                    RHARRIRIDTAINPELEALAEHLHYQWQGF
                              |||||||||||||||||||||||||||||
orf146a    KLNGSEIRLLDRHFTLLQTDLQQTVALINGRHARRIRIDTAINPELEALAEHLHYQWQGF
               280       290       300       310       320       330

40         50         60         70         90
orf146.pep    LWLSTDMRQEISALVILLQRTRRKWLDAHERQHLRQSLLETREHGX
              ||||||:|||||||||||||||||||||||||||||||||||||:
orf146a       LWLSTNMRQEISALVILLQRTRRKWLDAHERQHLRQSLLETREHSX
                  340       350       360       370
```

The complete length ORF146a nucleotide sequence <SEQ ID 633> is:

```
   1 ATGAACACCT CGCAACGCAA CCGCCTCGTC AGCCGCTGGC
     TCAACTCCTA
  51 CGAACGCTAC CGCTACCGCC GCCTCATCCA CGCCGTCCGG
     CTCGGCGGGG
 101 CCGTCCTGTT CGCCACCGCC TCCGCCCGGC TGCTCCACCT
     CCAACACGGC
 151 GAGTGGATAG GGATGACCGT CTTCGTCGTC CTCGGCATGC
     TCCAGTTTCA
 201 AGGGGCGATT TACTCCAAGG CGGTGGAACG TATGCTCGGC
     ACGGTCATCG
 251 GGCTGGGCGC GGGTTTGGGC GTTTTATGGC TGAACCAGCA
     TTATTTCCAC
 301 GGCAACCTCC TCTTCTACCT CACCGTCGGC ACGGCAAGCG
     CACTGGCCGG
 351 CTGGGCGGCG GTCGGCAAAA ACGGCTACGT CCCTATGCTG
     GCGGGCTGA
 401 CGATGTGCAT GCTCATCGGC GACAACGGCA GCGAATGGTT
     CGACAGCGGC
 451 CTGATGCGCG CGATGAACGT CCTCATCGGC GCGGCCATCG
     CCATCGCCGC
 501 CGCCAAACTG CTGCCGCTGA AATCCACACT GATGTGGCGT
     TTCATGCTTG
 551 CCGACAACCT GACCGACTGC AGCAAAATGA TTGCCGAAAT
     CAGCAACGGC
 601 AGGCGCATGA CCCGCGAACG CCTCGAAGAG AACATGGCGA
     AAATGCGCCA
 651 AATCAACGCA CGCATGGTCA AAAGCCGCAG CCACCTCGCC
     GCCACATCGG
 701 GCGAAAGCCG CATCAGCCCC GCCATGATGG AAGCCATGCA
     GCACGCCCAC
 751 CGTAAAATTG TCAACACCAC CGAGCTGCTC CTGACCACCG
     CCGCCAAGCT
 801 GCAATCTCCC AAACTCAACG GCAGCGAAAT CCGGCTGCTT
     GACCGCCACT
 851 TCACACTGCT CCAAACCGAC CTGCAACAAA CCGTCGCCCT
     TATCAACGGC
 901 AGACACGCCC GCCGCATCCG CATCGACACC GCCATCAACC
     CCGAACTGGA
 951 AGCCCTCGCC GAACACCTCC ACTACCAATG GCAGGGCTTC
     CTCTGGCTCA
1001 GCACCAATAT GCGTCAGGAA ATTTCCGCCC TCGTCATCCT
     GCTGCAACGC
1051 ACCCGCCGCA AATGGCTGGA TGCCCACGAA CGCCAACACC
     TGCGCCAAAG
1101 CCTGCTTGAA ACACGGGAAC ACAGTTGA
```

This encodes a protein having amino acid sequence <SEQ ID 634>:

```
   1 MNTSQRNRLV SRWLNSYERY RYRRLIHAVR LGGAVLFATA
     SARLLHLQHG
  51 EWIGMTVFVV LGMLQFQGAI YSKAVERMLG TVIGLGAGLG
     VLWLNQHYFH
 101 GNLLFYLTVG TASALAGWAA VCKNGYVPML AGLTMCMLIG
     DNGSEWFDSG
 151 LMRAMNVLIG AAIAIAAAKL LPLKSTLMWR FMLADNLTDC
     SKMIAEISNG
 201 RRMTRERLEE NMAKMRQINA RNVKSRSHLA ATSGESRISP
     AMMEAMQHAH
 251 RKIVNTTELL LTTAAKLQSP KLNGSEIRLL DRHFTLLQTD
     LQQTVALING
 301 RHARRIRIDT AINPELEALA EHLHYQWQGF LWLSTNMRQE
     ISALVILLQR
 351 TRRKWLDAHE RQHLRQSLLE TREHS*
```

ORF146a and ORF146-1 show 99.5% identity in 374 aa overlap:

```
orf146a.pep     MNTSQRNRLVSRWLNSYERYRYRRLIHAVRLGGAVLFATASARLLHLQHGEWIGMTVFVV
                ||||||||||||||||||||||||||||||||||||||||||||||||||||||||||||
orf146-1        MNTSQRNRLVSRWLNSYERYRYRRLIHAVRLGGAVLFATASARLLHLQHGEWIGMTVFVV orf146a.pep     LGMLQFQGAIYSKAVERMLGTVIGLGAGLGVLWLNQHYFHGNLLFYLTVGTASALAGWAA
                ||||||||||||||||||||||||||||||||||||||||||||||||||||||||||||
orf146-1        LGMLQFQGAIYSKAVERMLGTVIGLGAGLGVLWLNQHYFHGNLLFYLTVGTASALAGWAA orf146a.pep     VGKNGYVPMLAGLTMCMLIGDNGSEWFDSGLMRAMNVLIGAAIAIAAAKLLPLKSTLMWR
                |||||||||||||||||||||||||||||:||||||||||||||||||||||||||||||
orf146-1        VGKNGYVPMLAGLTMCMLIGDNGSEWLDSGLMRAMNVLIGAAIAIAAAKLLPLKSTLMWR orf146a.pep     FMLADNLTDCSKMIAEISNGRRMTRERLEENMAKMRQINARMVKSRSHLAATSGESRISP
                ||||||:|||||||||||||||||||||||||||||||||||||||||||||||||||||
orf146-1        FMLADNLADCSKMIAEISNGRRMTRERLEENMAKMRQINARMVKSRSHLAATSGESRISP orf146a.pep     AMMEAMQHAHRKIVNTTELLLTTAAKLQSPKLNGSEIRLLDRHFTLLQTDLQQTVALING
                ||||||||||||||||||||||||||||||||||||||||||||||||||||||||||||
orf146-1        AMMEAMQHAHRKIVNTTELLLTTAAKLQSPKLNGSEIRLLDRHFTLLQTDLQQTVALING orf146a.pep     RHARRIRIDTAINPELEALAEHLHYQWQGFLWLSTNMRQEISALVILLQRTRRKWLDAHE
                ||||||||||||||||||||||||||||||||||||||||||||||||||||||||||||
orf146-1        RHARRIRIDTAINPELEALAEHLHYQWQGFLWLSTNMRQEISALVILLQRTRRKWLDAHE
```

```
orf146a.pep       RQHLRQSLLETREHSX
                  ||||||||||||||:
orf146-1          RQHLRQSLLETREHGX
```

Homology with a Predicted ORF from *N. gonorrhoeae*

ORF146 shows 97.3% identity over a 75aa overlap with a predicted ORF (ORF146ng) from *N. gonorrhoeae*:

```
orf146.pep                         RHARRIRIDTAINPELEALAEHLHYQWQGF    30
                                   ||||||||||||||||||||||||||||||
orf146ng    KLNGSEIRLLDRHFTLLQTDLQQTAALINGRHARRIRIDTAINPELEALAEHLHYQWQGF   364 orf146.pep  LWLSTDMRQEISALVILLQRTRRKWLDAHERQHLRQSLLETREHG    75
            ||||:|||||||||| |||||||||||||||||||||||||||||
orf146ng    LWLSTNMRQEISALVIPLQRTRRKWLDAHERQHLRQSLLETREHG   409
```

An ORF146ng nucleotide sequence <SEQ ID 635> was predicted to encode a protein having amino acid sequence <SEQ ID 636>:

```
  1 MSGVRFFSPA PIPSTDPPSG SLCFFTFPLQ TASDMNSSQR
    KRLSCRWLNS

51 YERYRHRRLI HAVRLGGTVL FATALARLLH LQHGEWIGMT
    VFVVLGMLQF

101 QGAIYSNAVE RMLGTVIGLG AGLGVLWLNQ HYFHGNLLFY
    LTIGTASALA

151 GWAAVGKNGY VPMLAGLTMC MLIGDNGSEW LDSGLMRAMN
    VLIGAAIAIA

201 AAKLLPLKST LMWRFMLADN LADCSKMIAE ISNGRRMTRE
    RLEQNMVKMR

251 QINARMVKSR SHLAATSGES RISPSMMEAM QHAHRKIVNT
    TELLLTTAAK

301 LQSPKLNGSE IRLLDRHFTL LQTDLQQTAA LINGRHARRI
    RIDTAINPEL

351 EALAEHLHYQ WQGFLWLSTN MRQEISALVI PLQRTRRKWL
    DAHERQHLRQ

401 SLLETREHG*
```

Further work revealed the following gonococcal DNA sequence <SEQ ID 637>:

```
  1 ATGAACTCCT CGCAACGCAA ACGCCTTTCC GgccGCTGGC
    TCAACTCCTA

51 CGAACGCTac cGCCaccGCC GCCTCATACA TGCCGTGCGG
    CTCGGCggaa 101 ccgtCCTGTT CGCCACCGCA CTCGCCCGgc tACTCCACCT
    CCAacacggc 151 gAATGGATAG GGAtgaCCGT CTTCGTCGTC CTCGGCATGC
    TCCAGTTCCA 201 AGGCgcgatt tActccaacg cggtgGAacg taTGctcggt
    acggtcatcg 251 ggctgGGCGC GGGTTTGGgc gTTTTATGGC TGAACCAGCA
    TTAtttccac 301 ggcaacCTcc tcttctacct gaccatcggc acggcaagcg
    cactggccgg 351 ctGGGCGGCG GTCGGCAAAA acggctacgt ccctatgctg
    GCGGGGctgA 401 CGATGTGCAT gctcatcggc gACAACGGCA GCGAATGGCT
    CGACAGCGGC

451 CTGATGCGCG CGATGAACGT CCTCATCGGC GCCGCCATCG
    CCATTGCCGC

501 CGCCAAACTG CTGCCGCTGA AATCCACACT GATGTGGCGT
    TTCATGCTTG

551 CCGACAACCT GGCCGACTGC AGCAAAATGA TTGCCGAAAT
    CAGCAACGGC

601 AGGCGTATGA CGCGCGAACG TTTGGAGCAG AATATGGTCA
    AAATGCGCCA

651 AATCAACGCA CGCATGGTCA AAAGCCGCAG CCACCTCGCC
    GCCACATCGG

701 GCGAAAGCCG CATCAGCCCC TCCATGATGG AAGCCATGCA
    GCACGCCCAC

751 CGCAAAATCG TCAACACCAC CGAGCTGCTC CTGACCACCG
    CCGCCAAGCT

801 GCAATCTCCC AAACTCAACG GCAGCGAAAT CCGGCTGCTC
    GACCGCCACT

851 TCACACTGCT CCAAACCGAC CTGCAACAAA CCGCCGCCCT
    CATCAACGGC

901 AGACACGCCC GCCGCATCCG CATCGACACC GCCATCAACC
    CCGAACTGGA

951 AGCCCTCGCC GAACACCTCC ACTACCAATG GCAGGGCTTC
    CTCTGGCTCA

1001 GCACCAATAT GCGTCAGGAA ATTTCCGCCC TCGTCATCCT
     GCTGCAACGC

1051 ACCCGCCGCA AATGGCTGGA TGCCCACGAA CGCCAACACC
     TGCGCCAAAG

1101 CCTGCTTGAA ACACGGGAAC ACGGCTGA
```

This corresponds to the amino acid sequence <SEQ ID 638; ORF146ng-1>:

```
  1 MNSSQRKRLS GRWLNSYERY RHRRLIHAVR LGGTVLFATA
    LARLLHLQHG

51 EWIGMTVFVV LGMLQFQGAI YSNAVERMLG TVIGLGAGLG
    VLWLNQHYFH

101 GNLLFYLTIG TASALAGWAA VGKNGYVPML AGLTMCMLIG
    DNGSEWLDSG

151 LMRAMNVLIG AAIAIAAAKL LPLKSTLMWR FMLADNLADC
    SKMIAEISNG
```

-continued

```
201 RRMTRERLEQ NMVKMRQINA RMVKSRSHLA ATSGESRISP
    SMMEAMQHAH

251 RKIVNTTELL LTTAAKLQSP KLNGSEIRLL DRHFTLLQTD
    LQQTAALING

301 RHARRIRIDT AINPELEALA EHLHYQWQGF LWLSTNMRQE
    ISALVILLQR

351 TRRKWLDAHE RQHLRQSLLE TREHG*
```

ORF146ng-1 and ORF146-1 show 96.5% identity in 375 aa overlap

```
orf146-1.pep    MNTSQRNRLVSRWLNSYERYRYRRLIHAVRLGGAVLFATASARLLHLQHGEWIGMTVFVV
                || :|||:|| :|||||||||:||||||||||:||||| |||||||||||||||||||
orf146ng-1      MNSSQRKRLSGRWLNSYERYRHRRLIHAVRLGGTVLFATALARLLHLQHGEWIGMTVFVV orf146-1.pep    LGMLQFQGAIYSKAVERMLGTVIGLGAGLGVLWLNQHYFHGNLLFYLTVGTASALAGWAA
                |||||||||||:||||||||||||||||||||||||||||||||||||:||||||||||
orf146ng-1      LGMLQFQGAIYSNAVERMLGTVIGLGAGLGVLWLNQHYFHGNLLFYLTIGTASALAGWAA orf146-1.pep    VGKNGYVPMLAGLTMCMLIGDNGSEWLDSGLMRAMNVLIGAAIAIAAAKLLPLKSTLMWR
                ||||||||||||||||||||||||||||||||||||||||||||||||||||||||||||
orf146ng-1      VGKNGYVPMLAGLTMCMLIGDNGSEWLDSGLMRAMNVLIGAAIAIAAAKLLPLKSTLMWR orf146-1.pep    FMLADNLADCSKMIAEISNGRRMTRERLEENMAKMRQINARMVKSRSHLAATSGESRISP
                ||||||||||||||||||||||||||||||:||:|||||||||||||||||||||||||
orf146ng-1      FMLADNLADCSKMIAEISNGRRMTRERLEQNMVKMRQINARMVKSRSHLAATSGESRISP orf146-1.pep    AMMEAMQHAHRKIVNTTELLLTTAAKLQSPKLNGSEIRLLDRHFTLLQTDLQQTVALING
                :|||||||||||||||||||||||||||||||||||||||||||||||||||||:||||
orf146ng-1      SMMEAMQHAHRKIVNTTELLLTTAAKLQSPKLNGSEIRLLDRHFTLLQTDLQQTAALING orf146-1.pep    RHARRIRIDTAINPELEALAEHLHYQWQGFLWLSTNMRQEISALVILLQRTRRKWLDAHE
                ||||||||||||||||||||||||||||||||||||||||||||||||||||||||||||
orf146ng-1      RHARRIRIDTAINPELEALAEHLHYQWQGFLWLSTNMRQEISALVILLQRTRRKWLDAHE orf146-1.pep    RQHLRQSLLETREHGX
                ||||||||||||||||
orf146ng-1      RQHLRQSLLETREHGX
```

Furthermore, ORF146ng-1 shows homology with a hypothetical *E. coli* protein:

```
sp|P33011|YEEA_ECOLI HYPOTHETICAL 40.0 KD PROTEIN IN COBU-SBMC INTERGENIC
REGION >gi|1736674|gnl|PID|d1016553 (D90838) ORF_ID: o348#20; similar to
[SwissProt Accession Number P33011] [Escherichia coli]
>gi|1736682|gnl|PID|d1016560 (D90839) ORF_ID: o348#20; similar to
[SwissProt Accession Number P33011] [Escherichia coli] >gi|1788318
(AE000292) f352; 100% identical to fragment YEEA_ECOLI SW: P33011 but
has 203 additional C-terminal residues [Escherichia coli] Length = 352
Score = 109 bits (271), Expect = 2e-23
Identities = 89/347 (25%), Positives = 150/347 (42%), Gaps = 21/347 (6%)
Query:  20 YRHRRLIHAVRLGGTVLFATALARLLHLQHGEWIGMTVFVVLGMLQFQGAIYSNAVERML   79
           YRH R++H  R+     L    + RL  +    W  +T+ V++G  F G +    A ER+
Sbjct:  15 YRHYRIVHGTRVALAFLLTFLIIRLFTIPESTWPLVTMVVIMGPISFWGNVVPRAFERIG   74

Query:  80 GTVIGLGAGLGVLWLNQHYFHGNLLFYLTIGTASALAGWAAVGKNGYVPMLAGLTMCMLI  139
           GTV+G  GL  L L        L +   A  L GW A+GK  Y  +L G+T+  +++
Sbjct:  75 GTVLGSILGLIALQLE---LISLPLMLVWCAAAMFLCGWLALGKKPYQGLLIGVTLAIVV  131

Query: 140 GDNGSEWLDSGLMRAMNVLIGXXXXXXXXXXKLLPLKSTLMWRFMLADNLADCSKMIAEISN  199
           G     E +D+ L R+ +V+G       + P ++ + WR  LA +L + +++        +
Sbjct: 132 GSPTGE-IDTALWRSGDVILGSLLAMLFTGIWPQRAFIHWRIQLAKSLTEYNRNYQSAFS  190

Query: 200 GRRMTRERLEQNMVKMRQINARMVKSRSHLAATSGESRISPSMMEAMQHAHRKIVNXXXX  259
            + R  RLE ++ K+       VK R  +A  S  E +RI   S+  E +Q   +R +V
Sbjct: 191 PNLLERPRLESHLQKLL---TDAVKMRGLIAPASKETRIPKSIYEGIQTINRNLVCMLEL  247

Query: 260 XXXXXXXXQSPK---LNGSEIRLLDRHFXXXXXXXXXXXAALINGRHARRIRIDTAINPEL  316
                   +      LN  ++R  D            AL  G           +N  +
Sbjct: 248 QINAYWATRPSHFVLLNAQKLR--DTQHMMQQILLSLVHALYEGNPQPVFANTEKLNDAV  305
```

```
Query: 317 EALAEHL--HYQWQ-------GFLWLSTNMRQEISALVILLQRTRRK      354
            E L + L  H+ +        G++WL+    ++ L  L+ R RK
Sbjct: 306 EELRQLLNNHHDLKVVETPIYGYVWLNMETAHQLELLSNLICRALRK      352
```

On the basis of this analysis, including the identification of several transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 76

The following partial DNA sequence was identified in *N. meningitidis* <SEQ ID 639>:

```
  1 . . . GCCGAAGACA CGCGCGTTAC CGCACAGCTT
        TTGAGCGCGT ACGGCATTCA

51 GGGCAAACTC GTCAGTGTGC GCGAACACAA CGAACGGCAG
    ATGGCGGACA

101 AGATTGTCGG CTATCTTTCA GACGGCATGG TTGTGGCACA
    GGTTTCCGAT

151 GCGGGTACGC CGGCCGTGTG CGACCCGGGC GCGAAACTCG
    CCCGCCGCGT

201 GCGTGAGGCC GGGTTTAAAG TCGTTCCCGT CGTGGGCGCA
    AC.GCGGTGA

251 TGGCGGCTTT GAGCGTGGCC GGTGTGGAAG GATCCGATTT
    TTATTTCAAC

301 GGTTTTGTAC CGCCGAAATC GGGAGAACGC AGGAAACTGT
    TTGCCAAATG

351 GGTGCGGGCG GCGTTTCCTA TCGTCATGTT TGAAACGCCG
    CACCGCATCG

401 GTGCAGCGCT TGCCGATATG GCGGAACTGT TCCCCGAACG
    CCGATTAATG

451 CTGGCGCGCA AAATTACGAA AACGTTTGAA ACGTTCTTAA
    GCGGCACGGT

501 TGGGGAAATT CAGACGGCAT TGTCTGCCGA CGGCGACCAA
    TCGCGCGGCG

551 AGATGGTGTT GGTGCTTTAT CCGGCGCAGG ATGAAAAACA
    CGAAGGCTTG

601 TCCGAGTCCG CGCAAAACAT CATGAAAATC CTCACAGCCG
    AGCTGCCGAC

651 CAAACAGGCG GCGGAGCTTG CTGCCAAAAT CACGGGCGAG
    GGAAAGAAAG

701 CTTTGTACGA T . . .
```

This corresponds to the amino acid sequence <SEQ ID 640; ORF147>:

```
  1 . . . AEDTRVTAQL LSAYGIQGKL VSVREHNERQ
        MADKIVGYLS DGMVVAQVSD

51 AGTPAVCDPG AKLARRVREA GFKVVPVVGA XAVMAALSVA
    GVEGSDFYFN

101 GFVPPKSGER RKLFAKWVRA AFPIVMFETP HRIGAALADM
    AELFPERRLM
```

```
151 LAREITKTFE TFLSGTVGEI QTALSADGDQ SRGEMVLVLY
    PAQDEKHEGL

201 SESAQNIMKI LTAELPTKQA AELAAKITGE GKKALYD . . .
```

Further work revealed the complete nucleotide sequence <SEQ ID 641>:

```
  1 ATGTTTCAGA AACATTTGCA GAAAGCCTCC GACAGCGTCG
    TCGGAGGGAC

51 ATTATACGTG GTTGCCACGC CCATCGGCAA TTTGGCGGAC
    ATTACCCTGC

101 GCGCTTTGGC GGTATTGCAA AAGGCGGACA TCATCTGTGC
    CGAAGACACG

151 CGCGTTACCG CACAGCTTTT GAGCGCGTAC GCCATTCAGG
    GCAAACTCGT

201 CAGTGTGCGC GAACACAACG AACGGCAGAT GGCGGACAAG
    ATTGTCGGCT

251 ATCTTTCAGA CGGCATGGTT GTGGCACAGG TTTCCGATGC
    GGGTACGCCG

301 GCCGTGTGCG ACCCGGGCGC GAAACTCGCC CGCCGCGTGC
    GTGAGGCCGG

351 GTTTAAAGTC GTTCCCGTCG TGGGCGCAAG CGCGGTGATG
    GCGGCTTTGA

401 GCGTGGCCGG TGTGGAAGGA TCCGATTTTT ATTTCAACGG
    TTTTGTACCG

451 CCGAAATCGG GAGAACGCAG GAAACTGTTT GCCAAATGGG
    TGCGGGCGGC

501 GTTTCCTATC GTCATGTTTG AAACGCCGCA CCGCATCGGT
    GCGACGCTTG

551 CCGATATGGC GGAACTGTTC CCCGAACGCC GATTAATGCT
    GGCGCGCGAA

601 ATTACGAAAA CGTTTGAAAC GTTCTTAAGC GGCACGGTTG
    GGGAAATTCA

651 GACGGCATTG TCTGCCGACG GCAACCAATC GCGCGGCGAG
    ATGGTGTTGG

701 TGCTTTATCC GGCGCAGGAT GAAAAACACG AAGGCTTGTC
    CGAGTCCGCG

751 CAAAACATCA TGAAAATCCT CACAGCCGAG CTGCCGACCA
    AACAGGCGGC

801 GGAGCTTGCT GCCAAAATCA CGGGCGAGGG AAAGAAAGCT
    TTGTACGATC

851 TGGCTCTGTC TTGGAAAAAC AAATAG
```

This corresponds to the amino acid sequence <SEQ ID 642; ORF147-1>:

```
  1 MFQKHLQKAS DSVVGGTLYV VATPIGNLAD ITLRALAVLQ
    KADIICA*EDT*

51 RVTAQLLSAY GIQGKLVSVR EHNERQMADK IVGYLSDGMV
    VAQVSDAGTP
```

```
101 AVCDPGAKLA RRVREAGFKV VPVVGASAVM AALSVAGVEG
    SDFYFNGFVP

151 PKSGERRKLF AKWVRAAFPI VMFETPHRIG ATLADMAELF
    PERRLMLARE

201 ITKTFETFLS GTVGEIQTAL SADGNQSRGE MVLVLYPAQD
    EKHEGLSESA

251 QNIMKILTAE LPTKQAAELA AKITGEGKKA LYDLALSWKN
    K*
```

Computer analysis of this amino acid sequence gave the following results:

Homology with Hypothetical Protein ORF286 of *E. coli* (Accession Number U18997)

ORF147 and *E. coli* ORF286 protein show 36% aa identity in 237aa overlap:

```
Orf147:   1 AEDTRVTAQLLSAYGIQGKLVSVREHNERQMADKIVGYLSDGMVVAQVSDAGTPAVCDPG   60
            AEDTR  T   LL  +GI   +L  ++   +HNE+Q A+  ++    L  +G   +A VSDAGTP   + DPG
Orf286:  43 AEDTRHTGLLLQHFGINARLFALHDHNEQQKAETLLAKLQEGQNIALVSDAGTPLINDPG  102

Orf147:  61 AKLARRVREXXXXXXXXXXXXXXXXXXXXXXXXXXEGSDFYFNGFVPPFKSGERRKLFAKWVRA  120
            L R  RE                                F + GF+P KS   RR
Orf286: 103 YHLVRTCREAGIRVVPLPGPCAAITALSAAGLPSDRFCYEGFLPAKSKGRRDALKAIEAE   162

Orf147: 121 AFPIVMFETPHRIGAALADMAELFPERR-LMLAREITKTFETFLSGTVGEIQTALSADGD  179
            ++  +E+  HR+   +L  D+   +    E R  ++LARE+TKT+ET        VGE+    +    D +
Orf286: 163 PRTLIFYESTHRLLDSLEDIVAVLGESRYVVLARELTKTWETIHGAPVGELLAWVKEDEN  222

Orf147: 180 QSRGEMVLVLYPAQDEKHEGLSESAQNIMKILTAELPTKQAAELAAKITGEGKKALY     236
            +  +GEMVL++       + E L     A     +  +L  AELP K+AA  LAA+I  G    K ALY
Orf286: 223 RRKGEMVLIV-EGHKAQEEDLPADALRTLALLQAELPLKKAAALAAEIHGVKKNALY     278
```

Homology with a Predicted ORF from *N. meningitidis* (Strain A)

ORF147 shows 96.6% identity over a237aa overlap with ORF75a from strain A of *N. meningitidis*:

```
                                              10        20        30
orf147.pep                          AEDTRVTAQLLSAYGIQGKLVSVREHNERQ
                                    ||||||||||||||||||||||||||||||
orf75a      TLYVVATPIGNLADITLRALAVLQKADIICAEDTRVTAQLLSAYGIQGKLVSVREHNERQ
            20        30        40        50        60        70

40        50        60        70        80        90
orf147.pep  MADKIVGYLSDGMVVAQVSDAGTPAVCDPGAKLARRVREAGFKVVPVVGAXAVMAALSVA
            ||||||||||||||||||||||||||||||||||||||||||:|||||||| ||||||||
orf75a      MADKIVGYLSDGMVVAQVSDAGTPAVCDPGAKLARRVREVGFKVVPVVGASAVMAALSVA
            80        90       100       110       120       130

100       110       120       130       140       150
orf147.pep  GVEGSDFYFNGFVPPKSGERRKLFAKWVRAAFPIVMFETPHRIGAALADMAELFPERRLM
            ||:|||||||||||||||||||||||||||:|||:|||||||||:|||||||||||||||
orf75a      GVAGSDFYFNGFVPPKSGERRKLFAKWVRVAFPVVMFETPHRIGATLADMAELFPERRLM
            140       150       160       170       180       190

160       170       180       190       200       210
orf147.pep  LAREITKTFETFLSGTVGEIQTALSADGDQSRGEMVLVLYPAQDEKHEGLSESAQNIMKI
            |||||||||||||||||||||||||:|||||||||||||||||||||||||||||||||
orf75a      LAREITKTFETFLSGTVGEIQTALAADGNQSRGEMVLVLYPAQDEKHEGLSESAQNIMKI
            200       210       220       230       240       250
```

```
                     220        230
    orf147.pep    LTAELPTKQAAELAAKITGEGKKALYD
                  |||||||||||||||||||||||||||
    orf75a        LTAELPTKQAAELAAKITGEGKKALYDLALSWKNKX
                     260       270       280       290
```

ORF147a is identical to ORF75a, which includes aa 56-292 of ORF75.

Homology with a Predicted ORF from *N. gonorrhoeae*

ORF147 shows 94.1% identity over a 237aa overlap with a predicted ORF (ORF147ng) from *N. gonorrhoeae*:

```
    orf147.pep                                  AEDTRVTAQLLSAYGIQGKLVSVREHNERQ    30
                                                ||||||||||||||||||:||||||||||
    orf147ng   TLYVVATPIGNLADITLRALAVLQKADIICAEDTRVTAQLLSAYGIQGRLVSVREHNERQ    85
    orf147.pep MADKIVGYLSDGMVVAQVSDAGTPAVCDPGAKLARRVREAGFKVVPVVGAXAVMAALSVA    90
               |||::|:|||:||||||||||||||||||||||||||||||||||||||| ||||||||
    orf147ng   MADKIVGFLSDGLVVAQVSDAGTPAVCDPGAKLARRVREAGFKVVPVVGASAVMAALSVA   145
    orf147.pep GVEGSDFYFNGFVPPKSGERRKLFAKWVRAAFPIVMFETPHRIGAALADMAELFPERRLM   150
               || |||||||||||||||||||||||||||||||:|||||||||:|||||||||||||||
    orf147ng   GVAESDFYFNGFVPPKSGERRKLFAKWVRAAFPVVMFETPHRIGATLADMAELFPERRLM   205
    orf147.pep LAREITKTFETFLSGTVGEIQTALSADGDQSRGEMVLVLYPAQDEKHEGLSESAQNIMKI   210
               |||||||||||||||||||||||||:||:||||||||||||||||||||||||||| |||
    orf147ng   LAREITKTFETFLSGTVGEIQTALAADGNQSRGEMVLVLYPAQDEKHEGLSESAQNAMKI   265
    orf147.pep LTAELPTKQAAELAAKITGEGKKALYD                                   237
               |:|||||||||||||||||||||||||
    orf147ng   LAAELPTKQAAELAAKITGEGKKALYDLALSWKNKX                          300
```

An ORF147ng nucleotide sequence <SEQ ID 643> was predicted to encode a protein having amino acid sequence <SEQ ID 644>:

```
  1 MSVFQTAFFM FQKHLQKASD SVVGGTLYVV ATPIGNLADI
    TLPALAVLQK

51 ADIICAEDTR VTAQLLSAYG IQGRLVSVRE HNERQMADKV
    IGFLSDGLVV

101 AQVSDAGTPA VCDPGAKLAR RVREAGFKVV PVVGASAVMA
    ALSVAGVAES

151 DFYPNGFVPP KSGERRKLFA KWVRAAFPVV MFETPHRIGA
    TLADMAELFP

201 ERRLMLAREI TKTFETFLSG TVGEIQTALA ADGNQSRGEM
    VLVLYPAQDE

251 KHEGLSESAQ NAMKILAAEL PTKQAAELAA KITGEGKKAL
    YDLALSWKNK

301 *
```

Further work revealed the following gonococcal DNA sequence <SEQ ID 645>:

```
  1 ATGTTTCAGA ACACTTGCA GAAAGCCTCC GACAGCGTCG
    TCGGAGGGAC

51 ATTATACGTG GTTGCCACGC CCATCGGCAA TTTGGCAGAC
    ATTACCCTGC

101 GCGCTTTGGC GGTATTGCAA AAGGCGGACA TCATTTGTGC
    CGAAGACACG

151 CGCGTTACTG CGCAGCTTTT GAGCGCGTAC GGCATTCAGG
    GCAGGTTGGT

201 CAGTGTGCGC GAACACAACG AGCGGCAGAT GGCGGACAAG
    GTAATCGGTT

251 TCCTTTCAGA CGGCCTGGTT GTGGCGCAGG TTTCCGATGC
    GGGTACGCCG

301 GCCGTGTGCG ACCCGGGCGC GAAACTCGCC CGCCGCGTGC
    GCGAAGCAGG

351 GTTCAAAGTC GTTCCCGTCG TCGGCGCAAG CGCGGTAATG
    GCGGCGTTGA

401 GTGTGGCCGG TGTGGCGGAA TCCGATTTTT ATTTCAACGG
    TTTTGTACCG

451 CCGAAATCGG GCGAACGTAG GAAATTGTTT GCCAAATGGG
    TGCGGGCGGC

501 ATTTCCTGTC GTCATGTTTG AAACGCCGCA CCGAATCGGG
    GCAACGCTTG

551 CCGATATGGC GGAATTGTTC CCCGAACGCC GTCTGATGCT
    GGCGCGCGAA

601 ATCACGAAAA CGTTTGAAAC GTTCTTAAGC GGCACGGTTG
    GGGAAATTCA

651 GACGGCATTG GCGGCGGACG GCAACCAATC CCGCGGCGAG
    ATGGTGTTGG

701 TGCTTTATCC GGCGCAGGAT GAAAAACACG AAGGCTTGTC
    CGAGTCTGCG

751 CAAAATGCGA TGAAAATCCT TGCGGCCGAG CTGCCGACCA
    AGCAGGCGGC
```

```
801 GGAGCTTGCC GCCAAGATTA CAGGTGAGGG CAAAAAGGCT
    TTGTACGATT

851 TGGCACTGTC GTGGAAAAAC AAATGA
```

This corresponds to the amino acid sequence <SEQ ID 646; ORF147ng-1>:

```
  1 MFQKHLQKAS DSVVGGTLYV VATPIGNLAD ITLRALAVLQ
    KADIICAEDT

51 RVTAQLLSAY GIQGRLVSVR EHNERQMADK VIGFLSDGLV
    VAQVSDAGTP

101 AVCDPGAKLA RRVREAGFKV VPVVGASAVM AALSVAGVAE
    SDFYFNGFVP

151 PKSGERRKLF AKWVRAAFPV VMFETPHRIG ATLADMAELF
    PERRLMLARE

201 ITKTFETFLS GTVGEIQTAL AADGNQSRGE MVLVLYPAQD
    EKHEGLSESA

251 QNAMKILAAE LPTKQAAELA AKITGEGKKA LYDLALSWKN
    K*
```

ORF147ng shows homology to a hypothetical *E. coli* protein:

```
sp|P45528|YRAL_ECOLI HYPOTHETICAL 31.3 KD PROTEIN IN AGAI-MTR INTERGENIC
REGION (F286)
>gi|606086 (U18997) ORF_f286 [Escherichia coli]
>gi|1789535 (AE000395) hypothetical 31.3 kD protein in agai-mtr
intergenic region [Escherichia coli] Length = 286
Score = 218 bits (550), Expect = 3e-56
Identities = 128/284 (45%), Positives 171/284 (60%), Gaps = 4/284 (1%)

Query:    4 KHLQKASDSVVGGTLYVVATPIGNLADITLRALAVLQKADIICAEDTRVTAQLLSAYGIQ   63
            K  Q A +S    G LY+V TPIGNLADIT RAL VLQ  D+I AEDTR T  LL +GI
Sbjct:    2 KQHQSADNSQ--GQLYIVPTPIGNLADITQRALEVLQAVDLIAAEDTRHTGLLLQHFGIN   59

Query:   64 GRLVSVREHNERQMADKVIGFLSDGLVVAQVSDAGTPAVCDPGAKLARRVREAGFKVVPV  123
            RL ++ +HNE+Q A+ ++   L +G  +A VSDAGTP + DPG  L R  REAG +VVP+
Sbjct:   60 ARLFALHDHNEQQKAETLLAKLQEGQNIALVSOAGTPLINDPGYHLVRTCREAGIRVVPL  119

Query:  124 VGASAVMAALSVAGVAESDFYFNGFVPPKSGERRKLFAKWVRAAFPVVMFETPHRIGATL  183
              G  A + ALS AG+    F + GF+P KS  RR        ++ +E+ HR+   +L
Sbjct:  120 PGPCAAITALSAAGLPSDRFCYEGFLPAKSKGRRDALKAIEAEPRTLIFYESTHRLLDSL  179

Query:  184 ADMAELFPERR-LMLAREITKTFETFLSGTVGEIQTALAADGNQSRGEMVLVLYPAQDEK  242
             D+  +  E R ++LARE+TKT+ET      VGE+   + D N+ +GEMVL++       +
Sbjct:  180 EDIVAVLGESRYVVLARELTKTWETIHGAPVGELLAWVKE0ENRRKGEMVLIV-EGHKAQ  238

Query:  243 HEGLSESAQNAMKILAAELPTKQAAELAAKITGEGKKALYDLAL                286
             E L   A   + +LAELP K+AA LAA+I G  K ALY  AL
Sbjct:  239 EEDLPADALRTLALLQAELPLKKAAALAAEIHGVKKNALYKYAL                282
```

Based on the computer analysis and the presence of a putative transmembrane domain in the gonococcal protein, it is predicted that these proteins from *N. meningitidis* and *N. gonorrhoeae*, and their epitopes, could be useful antigens for vaccines or diagnostics, or for raising antibodies.

Example 77

The following partial DNA sequence was identified in *N. meningitidis* <SEQ ID 647>

```
  1 ATGAAAACAA CCGACAAACG GACAACCGAA ACACACCGCA
    AAGCCCCGAA

51 AACCGGTCGC ATCCGCTTCT C.GCTGCTTA CTTAGCCATA
    TGCCTGTCGT

101 TCGGCATTCT TCCCCAAGCC TGGGCGGGAC ACACTTATTT
    CGGCATCAAC

151 TACCAATACT ATCGCGACTT TGCCGAAAAT AAAGGCAAGT
    TTGCAGTCGG

201 GGCGAAAGAT ATTGAGGTTT ACAACAAAAA AGGGGAGTTG
    GTCGGCAAAT

251 CAATGACAAA AGCCCCGATG ATTGATTTTT CTGTGGTGTC
    GCGTAACGGC

301 GTGGCGGcAT TGGTGGGCGt ATCAATATAT TGTGAGCGTG
    GCACATAACG

351 GCGGCTATAA CAACGTTGAT TTTGGTGCGG AAGGAAk.AA
    tATCCC.GAT

401 CAACAwCGww TTACTTATAA AATTGTGAAA CGGAATAATT
    ATAAAGCAGG

451 GACTAAAGGC CATCCTTATG GCGGCGATTA TCATATGCCG
    CGTTTGCATA

501 AATwTGTCAC AGATGCAGAA CCTGTTGAAA TGACCAGTTA
    TATGGATGGG

551 CGGAAATATA TCGATCAAAA TAATTACCCT GACCGTGTTC
    GTATTGGGGC

601 AGGCAGGCAA TATTGGCGAT CTGATGAAGA TGAGCCCAAT
    AACCGCGAAA

651 GTTCATATCA TATTGCAAGT .......... ..........
    ..........

701 .......... .....GGCTC ACCAATGTTT ATCTATGATG
    CCCAAAAGCA
```

```
 751 AAAGTGGTTA ATTAATGGGG TATTGCAAAC GGGCAACCCC
     TATATAGGAA

801 AAAGCAATGG CTTCCAGCTG GTTCGTAAAG ATTGGTTCTA
     TGATGAAATC

851 TTTGCTGGAG ATACCCATTC AGTATTCTAC GAACCACGTC
     AAAATGGGAA

901 ATACTCTTTT AACGACGATA ATAATGGCAC AGGAAAAATC
     AATGCCAAAC

951 ATGAACACAA TTCTCTGCCT AATAGATTAA AACACGAAC
     CGTTCAATTG

1001 TTTAATGTTT CTTTATCCGA GACAGCAAGA GAACCTGTTT
     ATCATGCTGC

1051 AGGTGGTGTC AACAGTTATC GACCCAGACT GAATAATGGA
     GAAAATATTT

1101 CCTTTATTGA CGAAGGAAAA GGCGAATTGA TACTTACCAG
     CAACATCAAT

1151 CAAGGTGCTG GAGGATTATA TTTCCAAGGA GATTTTACGG
     TCTCGCCTGA

1201 AAATAACGAA ACTTGGCAAG GCGCGGGCGT TCATATCAGT
     GAAGACAGTA

1251 CCGTTACTTG GAAAGTAAAC GGCGTGGCAA ACGACCGCCT
     GTCCAAAATC

1301 GGCAAAGGCA CGCTG.....  .......... ..........
     ..........

//

2101 .......... .......... .......... ..........
     ...GATAAAG

2151 TGACTGCTTC ATTGACTAAG ACCGACATCA GCGGCAATGT
     CGATCTTGCC

2201 GATCACGTCG ATTTAAATCT CACAGGGCTT GCCACACTCA
     ACGGCAATCT

2251 TAGTGCAAAT GGCGATACAC GTTATACAGT CAGCCACAAC
     GCCACCCAAA

2301 ACGGCAACCk TAgCCtCGtG G.sAATGcCC AAGCAACATT
     TAATCAAGCC

2351 ACATTAAACG GCAACACATC GGCTTCgGGC AATGCTTCAT
     TTAATCTAAG

2401 CGACCACGCC GTACAAAACG GCAGTCTGAC GCTTTCCGGC
     AACGCTAAGG

2451 CAAACGTAAG CCATTCCGCA CTCAACGGTA ATGTCTCCCT
     AGCCGATAAG

2501 GCAGTATTCC ATTTTGAAAG CAGCCGCTTT ACCGGACAAA
     TCAGCGGCGG

2551 CAagGATACG GCATTACACT TAAAAGACAG CGAATGGACG
     CTGCCGTCAg

2601 GarCGGAATT AGGCAATTTA AACCTTGACA ACGCCACCAT
     TACaCTCAAT

2651 TCCGCCTATC GCCACGATGC GGCAGGGGCG CAAACCGGCA
     GTGCGACAGA

2701 TGCGCCGCGC CGCCGTTCGC GCCGTTCGCG CCGTTCCCTA
     TTATmCGTTA

2751 CACCGCCAAC TTCGGTAGAA TCCCGTTTCA ACACGCTGAC
     GGTAAACGGC

2801 AAATTGAACG GTCAGGGAAC ATTCCGCTTT ATGTCGGAAC
     TCTTCGGCTA

2851 CCGCAGCGAC AAATTGAAGC TGGCGGAAAG TTCCGAAGGC
     ACTTACACCT

2901 TGGCGGTCAA CAATACCGGC AACGAACCTG CAAGCCTCGA
     ACAATTGACG

2951 GTAGTGGAAG GAAAAGACAA CAAACCGCTG TCCGAAAACC
     TTAATTTCAC

3001 CCTGCAAAAC GAACACGTCG ATGCAGGCGC GTGG......
     ..........

//

3551 .......... .......... ....TTAGAC CGCGTATTTG
     CCGAAGACCG

3601 CCGCAACGCC GTTTGGACAA GCGGCATCCG GGACACCAAA
     CACTACCGTT

3651 CGCAAGATTT CCGCGCCTAC CGCCAACAAA CCGACCTGCG
     CCAAATCGGT

3701 ATGCAGAAAA ACCTCGGCAG CGGGCGCGTC GGCATCCTGT
     TTTCGCACAA

3751 CCGGACCGAA AACACCTTCG ACGACGGCAT CGGCAACTCG
     GCACGGCTTG

3801 CCCACGGCGC CGTTTTCGGG CAATACGGCA TCGACAGGTT
     CTACATCGGC

3851 ATCAGnCGCG GGCGCGGGTT TTAGCAGCGG CAGCCTTTcA
     GACGGCATCG

3901 GAGsmAAAwT CCGCCGCCGC GTGCtGCATT ACGGCATTCA
     GGCACGAtAC

3951 CGCGCCGgtt tCggCGgATt CGGCATCGAA CCGCACATCG
     GCGCAACGCg 4001 ctATTTCGTC CAAAAAGCGG ATTACCGCTA CGAAAACGTC
     AATATCGCCA 4051 CCCCCGGCCT TGCATTCAAC CGcTACCGCG CGGGCATTAa
     GGCAGATTAT

4101 TCATTCAAAC CGGCGCAACA CATTTCCATC ACGCCTTATT
     TGAGCCTGTC

4151 CTATACCGAT GCCGCTTCGG GCAAAGTCCG AACACGCGTC
     AATACCGCCG

4201 TATTGGCTCA GGATTTCGGC AAAACCCGCA GTGCGGAATG
     GGgCGTAAAC

4251 GCCGAAATCA AAGGTTTCAC GCTGTCCCTC CACGCTGCCG
     CCGCCAAAGG

4301 CCCGCAACTG GAAGCGCAAC ACAGCGCGGG CATCAAATTA
     GGCTACCGCT

4351 GGTAA . . .
```

This corresponds to the amino acid sequence <SEQ ID 648; ORF1>:

```
  1 MKTTDKRTTE THRKAPKTGR IRFXAAYLAI CLSFGILPQA
    WAGHTYFGIN

51 YQYYRDFAEN KGKFAVGAKD IEVYNKKGEL VGKSMTKAPM
    IDFSVVSRNG

101 VAALVGVQYI VSVAHNGGYN NVDFCAEGXN IXDQXRXTYK
    IVKRNNYKAG
```

-continued

```
151  TKGHPYGGDY HMPRLHKXVT DAEPVEMTSY MDGRKYIDQN
     NYPDRVRIGA

201  GRQYWRSDED EPNNRESSYH IAS....... ........GS
     PMFIYDAQKQ

251  KWLINGVLQT GNPYIGKSNG FQLVRKDWFY DEIFAGDTHS
     VFYEPRQNGK

301  YSFNDDNNGT GKINAKHEHN SLPNRLKTRT VQLFNVSLSE
     TAREPVYHAA

351  GGVNSYRPRL NNGENISFID EGKGELILTS NINQCAGGLY
     FQGDFTVSPE

401  NNETWQGAGV HISEDSTVTW KVNGVANDRL SKIGKGTL..
     ..........

//

701  .......... ....DKVTAS LTKTDISGNV DLADHAHLNL
     TGLATLNGNL

751  SANGDTRYTV SNNATQNGNX SLVXNAQATF NQATLNGNTS
     ASGNASFNLS

801  DHAVQNGSLT LSGNAKANVS HSALNGNVSL ADKAVFHFES
     SRFTGQISGG

851  KDTALHLKDS EWTLPSGXEL GNLNLDNATI TLNSAYRHDA
     AGAQTGSATD

901  APRRRSRRSR RSLLXVTPPT SVESRFNTLT VNGKLNGQGT
     FRFMSELFGY

951  RSDKLKLAES SEGTYTLAVN NTGNEPASLE QLTVVEGKDN
     KPLSENLNFT

1001 LQNEHVDAGA W......... .......... ..........
     ..........

//

1151 .......... .......... .......... ..........
     .LDRVFAEDR

1201 RNAVWTSGIR DTKHYRSQDF RAYRQQTDLR QIGMQKNLGS
     GRVGILFSHN

1251 RTENTFDDGI GNSARLAHGA VFGQYGIDRF YIGISAGAGF
     SSGSLSDGIG

1301 XKXRRRVLHY GIQARYRAGF GGFGIEPHIG ATRYFVQKAD
     YRYENVNIAT

1351 PGLAFNRYRA GIKADYSFKP AQHISITPYL SLSYTDAASG
     KVRTRVNTAV

1401 LAQDFGKTRS AEWGVNAEIK GETLSLHAAA AKGPQLEAQH
     SAGIKLGYRW

1451 *
```

Further sequencing analysis revealed the complete nucleotide sequence <SEQ ID 649>:

```
   1 ATGAAAACAA CCGACAAACG GACAACCGAA ACACACCGCA
     AAGCCCCGAA

51 AACCGGCCGC ATCCGCTTCT CGCCTGCTTA CTTAGCCATA
     TGCCTGTCGT

101 TCGGCATTCT TCCCCAAGCC TGGGCGGGAC ACACTTATTT
     CGGCATCAAC

151 TACCAATACT ATCGCGACTT TGCCGAAAAT AAAGGCAAGT
     TTGCAGTCGG

201 GGCGAAAGAT ATTGAGGTTT ACAACAAAAA AGGGGAGTTG
     GTCGGCAAAT

251 CAATGACAAA AGCCCCGATG ATTGATTTTT CTGTGGTGTC
     GCGTAACGGC

301 GTGGCGGCAT TGGTGGGCGA TCAATATATT GTGAGCGTGG
     CACATAACGG

351 CGGCTATAAC AACGTTGATT TTGGTGCGGA AGGAAGAAAT
     CCCGATCAAC

401 ATCGTTTTAC TTATAAAATT GTGAAACGGA ATAATTATAA
     AGCAGGGACT

451 AAAGGCCATC CTTATGGCGG CGATTATCAT ATGCCGCGTT
     TGCATAAATT

501 TGTCACAGAT GCAGAACCTG TTGAAATGAC CAGTTATATG
     GATGGGCGGA

551 AATATATCGA TCAAAATAAT TACCCTGACC GTGTTCGTAT
     TGGGGCAGGC

601 AGGCAATATT GGCGATCTGA TGAAGATGAG CCCAATAACC
     GCGAAAGTTC

651 ATATCATATT GCAAGTGCGT ATTCTTGGCT CGTTGGTGGC
     AATACCTTTG

701 CACAAAATGG ATCAGGTGGT GGCACAGTCA ACTTAGGTAG
     TGAAAAAATT

751 AAACATAGCC CATATGGTTT TTTACCAACA GGAGGCTCAT
     TTGGCGACAG

801 TGGCTCACCA ATGTTTATCT ATGATGCCCA AAAGCAAAAG
     TGGTTAATTA

851 ATGGGGTATT GCAAACGGGC AACCCCTATA TAGGAAAAAG
     CAATGGCTTC

901 CAGCTGGTTC GTAAAGATTG GTTCTATGAT GAAATCTTTG
     CTGGAGATAC

951 CCATTCAGTA TTCTACGAAC CACGTCAAAA TGGGAAATAC
     TCTTTTAACG

1001 ACGATAATAA TGGCACAGGA AAAATCAATG CCAAACATGA
     ACACAATTCT

1051 CTGCCTAATA GATTAAAAAC ACGAACCGTT CAATTGTTTA
     ATGTTTCTTT

1101 ATCCGAGACA GCAAGAGAAC CTGTTTATCA TGCTGCAGGT
     GGTGTCAACA

1151 GTTATCGACC CAGACTGAAT AATGGAGAAA ATATTTCCTT
     TATTGACGAA

1201 GGAAAAGGCG AATTGATACT TACCAGCAAC ATCAATCAAG
     GTGCTGGAGG

1251 ATTATATTTC CAAGGAGATT TTACGGTCTC GCCTGAAAAT
     AACGAAACTT

1301 GGCAAGGCGC GGGCGTTCAT ATCAGTGAAG ACAGTACCGT
     TACTTGGAAA

1351 GTAAACGGCG TGGCAAACGA CCGCCTGTCC AAAATCGGCA
     AAGGCACGCT

1401 GCACGTTCAA GCCAAGGGG AAAACCAAGG CTCGATCAGC
     GTGGGCGACG

1451 GTACAGTCAT TTTGGATCAG CAGGCAGACG ATAAAGGCAA
     AAAACAAGCC
```

-continued

```
1501 TTTAGTGAAA TCGGCTTGGT CAGCGGCAGG GGTACGGTGC
     AACTGAATGC
1551 CGATAATCAG TTCAACCCCG ACAAACTCTA TTTCGGCTTT
     CGCGGCGGAC
1601 GTTTGGATTT AAACGGGCAT TCGCTTTCGT TCCACCGTAT
     TCAAAATACC
1651 GATGAAGGGG CGATGATTGT CAACCACAAT CAAGACAAAG
     AATCCACCGT
1701 TACCATTACA GGCAATAAAG ATATTGCTAC AACCGGCAAT
     AACAACAGCT
1751 TGGATAGCAA AAAAGAAATT GCCTACAACG GTTGGTTTGG
     CGAGAAAGAT
1801 ACGACCAAAA CGAACGGGCG GCTCAACCTT GTTTACCAGC
     CCGCCGCAGA
1851 AGACCGCACC CTGCTGCTTT CCGGCGGAAC AAATTTAAAC
     GGCAACATCA
1901 CGCAAACAAA CGGCAAACTG TTTTTCAGCG GCAGACCAAC
     ACCGCACGCC
1951 TACAATCATT TAAACGACCA TTGGTCGCAA AAAGAGGGCA
     TTCCTCGCGG
2001 GGAAATCGTG TGGGACAACG ACTGGATCAA CCGCACATTT
     AAAGCGGAAA
2051 ACTTCCAAAT TAAAGGCGGA CAGGCGGTGG TTTCCCGCAA
     TGTTGCCAAA
2101 GTGAAAGGCG ATTGGCATTT GAGCAATCAC GCCCAAGCAG
     TTTTTGGTGT
2151 CGCACCGCAT CAAAGCCACA CAATCTGTAC ACGTTCGGAC
     TGGACGGGTC
2201 TGACAAATTG TGTCGAAAAA ACCATTACCG ACGATAAAGT
     GATTGCTTCA
2251 TTGACTAAGA CCGACATCAG CGGCAATGTC GATCTTGCCG
     ATCACGCTCA
2301 TTTAAATCTC ACAGGGCTTG CCACACTCAA CGGCAATCTT
     AGTGCAAATG
2351 GCGATACACG TTATACAGTC AGCCACAACG CCACCCAAAA
     CGGCAACCTT
2401 AGCCTCGTGG GCAATGCCCA AGCAACATTT AATCAAGCCA
     CATTAAACGG
2451 CAACACATCG GCTTCGGGCA ATGCTTCATT TAATCTAAGC
     GACCACGCCG
2501 TACAAAACGG CAGTCTGACG CTTTCCGGCA ACGCTAAGGC
     AAACGTAAGC
2551 CATTCCGCAC TCAACGGTAA TGTCTCCCTA GCCGATAAGG
     CAGTATTCCA
2601 TTTTGAAAGC AGCCGCTTTA CCGGACAAAT CAGCGGCGGC
     AAGGATACGG
2651 CATTACACTT AAAAGACAGC GAATGGACGC TGCCGTCAGG
     CACGGAATTA
2701 GGCAATTTAA ACCTTGACAA CGCCACCATT ACACTCAATT
     CCGCCTATCG
2751 CCACGATGCG GCAGGGCGC AAACCGGCAG TGCGACAGAT
     GCGCCGCGCC
```

```
2801 GCCGTTCGCG CCGTTCGCGC CGTTCCCTAT TATCCGTTAC
     ACCGCCAACT
2851 TCGGTAGAAT CCCGTTTCAA CACGCTGACG GTAAACGGCA
     AATTGAACGG
2901 TCAGGGAACA TTCCGCTTTA TGTCGGAACT CTTCGGCTAC
     CGCAGCGACA
2951 AATTGAAGCT GGCGGAAAGT TCCGAAGGCA CTTACACCTT
     GGCGGTCAAC
3001 AATACCGGCA ACGAACCTGC AAGCCTCGAA CAATTCACGG
     TAGTGGAAGG
3051 AAAAGACAAC AAACCGCTGT CCGAAAACCT TAATTTCACC
     CTGCAAAACG
3101 AACACGTCGA TGCCGGCGCG TGGCGTTACC AACTCATCCG
     CAAAGACGGC
3151 GAGTTCCGCC TGCATAATCC GGTCAAAGAA CAAGAGCTTT
     CCGACAAACT
3201 CGGCAAGGCA GAAGCCAAAA AACAGGCGGA AAAAGACAAC
     GCGCAAAGCC
3251 TTGACGCGCT GATTGCGGCC GGGCGCGATG CCGTCGAAAA
     GACAGAAAGC
3301 GTTGCCGAAC CGGCCCGGCA GGCAGGCGGG GAAAATGTCG
     GCATTATGCA
3351 GGCGGAGGAA GAGAAAAAAC GGGTGCAGGC GGATAAAGAC
     ACCGCCTTGG
3401 CGAAACAGCG CGAAGCGGAA ACCCGGCCGG CTACCACCGC
     CTTCCCCCGC
3451 GCCCGCCGCG CCCGCCGGGA TTTGCCGCAA CTGCAACCCC
     AACCGCAGCC
3501 CCAACCGCAG CGCGACCTGA TCAGCCGTTA TGCCAATAGC
     GGTTTCAGTG
3551 AATTTTCCGC CACGCTCAAC AGCGTTTTCG CCGTACAGGA
     CGAATTAGAC
3601 CGCGTATTTG CCGAAGACCG CCGCAACGCC GTTTGGACAA
     GCGGCATCCG
3651 GGACACCAAA CACTACCGTT CGCAAGATTT CCGCGCCTAC
     CGCCAACAAA
3701 CCGACCTGCG CCAAATCGGT ATGCAGAAAA ACCTCGGCAG
     CGGGCGCGTC
3751 GGCATCCTGT TTTCGCACAA CCGGACCGAA AACACCTTCG
     ACGACGGCAT
3801 CGGCAACTCG GCACGGCTTG CCCACGGCGC CGTTTTCGGG
     CAATACGGCA
3851 TCGACAGGTT CTACATCGGC ATCAGCGCGG GCGCGGGTTT
     TAGCAGCGGC
3901 ACCCTTTCAG ACGGCATCGG AGCCAAAATC CGCCGCCGCG
     TGCTGCATTA
3951 CGGCATTCAG GCACGATACC GCGCCGGTTT CGGCGGATTC
     GGCATCGAAC
4001 CGCACATCGG CGCAACGCGC TATTTCGTCC AAAAAGCGGA
     TTACCGCTAC
4051 GAAAACGTCA ATATCGCCAC CCCCGGCCTT GCATTCAACC
     GCTACCGCGC
```

```
4101 GGGCATTAAG GCAGATTATT CATTCAAACC GGCGCAACAC
     ATTTCCATCA
4151 CGCCTTATTT GAGCCTGTCC TATACCGATG CCGCTTCGGG
     CAAAGTCCGA
4201 ACACGCGTCA ATACCGCCGT ATTGGCTCAG GATTTCGGCA
     AAACCCGCAG
4251 TGCGGAATGG GGCGTAAACG CCGAAATCAA AGGTTTCACG
     CTGTCCCTCC
4301 ACGCTGCCGC CGCCAAAGGC CCGCAACTGG AAGCGCAACA
     CAGCGCGGGC
4351 ATCAAATTAG GCTACCGCTG GTAA
```

This corresponds to the amino acid sequence <SEQ ID 650; ORF1-1>:

```
  1  MKTTDKRTTE THRKAFKTGR IRFSPAYLAI CLSFGILPQA
     WAGHTYFGIN
 51  YQYYRDFAEN KGKFAVGAKD IEVYNKKGEL VGKSMTKAPM
     IDFSVVSRNG
101  VAALVGDQYI VSVAHNGGYN NVDFGAEGRN PQQHRFTYKI
     VKRNNYKAGT
151  KGHPYGGDYH MPRLHKFVTD AEPVEMTSYM DGRKYIDQNN
     YPDRVRIGAG
201  RQYWRSDEDE PNNRESSYHI ASAYSWLVGG NTFAQNGSGG
     GTVNLGSEKI
251  KHSPYGFLPT GGSFGDSGSP MFIYDAQKQK WLINGVLQTG
     NPYIGKSNGF
301  QLVRKDWFYD EIFAGDTHSV FYEPRQNGKY SFNDDNNGTG
     KINAKHEHNS
351  LPNRLKTRTV QLFNVSLSET AREPVYHAAG GVNSYRPRLN
     NGENISFIDE
401  GKGELILTSN INQGAGGLYF QGDFTVSPEN NETWQGAGVH
     ISEDSTVTWK
451  VNGVANDRLS KIGKGTLHVQ AKGENQGSIS VGDGTVILDQ
     QADDKGKKQA
501  FSEIGLVSGR GTVQLNAONQ FNPDKLYFGF RGGRLDLNGH
     SLSFHRIQNT
551  DEGAMIVNHN QDKESTVTIT GNKDIATTGN NNSLDSKKEI
     AYNGWFGEKD
601  TTKTNGRLNL VYQPAAEDRT LLLSGGTNLN GNITQTNGKL
     FFSGRPTPHA
651  YNHLNDHWSQ KEGIPRGEIV WDNDWINRTF KAENFQIKGG
     QAVVSRNVAK
701  VKGDWHLSNH AQAVFGVAPH QSHTICTRSD WTGLTNCVEK
     TITDDKVIAS
751  LTKTDISGNV DLADHAHLNL TGLATLNGNL SANGDTRYTV
     SHNATQNGNL
801  SLVGNAQATF NQATLNGNTS ASGNASFNLS DHAVQNGSLT
     LSGNAKANVS
851  HSALNGNVSL ADKAVFHFES SRFTGQISGG KDTALHLKDS
     EWTLPSGTEL
901  GNLNLDNATI TLNSAYRHDA AGAQTGSATD APRRRSRRSR
     RSLLSVTPPT
951  SVESRFNTLT VNGKLNGQGT FRFMSELFGY RSDKLKLAES
     SEGTYTLAVN
1001 NTGNEPASLE QLTVVEGKDN KPLSENLNFT LQNEHVDAGA
     WRYQLIRKDG
1051 EFRLHNPVKE QELSDKLGKA EAKKQAEKDN AQSLDALIAA
     GRDAVEKTES
1101 VAEPARQAGG ENVGIMQAEE EKKRVQADKD TALAKQREAE
     TRPATTAFPR
1151 ARRARRDLPQ LQPQPQPQPQ RDLISRYANS GLSEFSATLN
     SVFAVQDELD
1201 RVFAEDRRNA VWTSGIRDTK HYRSQDFRAY RQQTDLRQIG
     MQKNLGSGRV
1251 GILFSHNRTE NTFDDGIGNS ARLAHGAVFG QYGIDRFYIG
     ISAGAGFSSG
1301 SLSDGIGGKI RRRVLHYGIQ ARYRAGFGGF GIEPHIGATR
     YFVQKADYRY
1351 ENVNIATPGL AFNRYRAGIK ADYSWKPAQH ISITPYLSLS
     YTDAASGKVR
1401 TRVNTAVLAQ DFGKTRSAEW GVNAEIKGFT LSLHAAAAKG
     PQLEAQHSAG
1451 IKLGYRW*
```

Computer analysis of these sequences gave the following results:

Homology with a Predicted ORF from *N. meningitidis* (Strain A)

ORF1 shows 57.8% identity over a 1456aa overlap with an ORF (ORF1a) from strain A of *N. meningitidis*:

```
                10         20         30         40         50         60
orf1.pep  MKTTDKRTTETHRKAPKTGRIRFXAAYLAICLSFGILPQAWAGHTYFGINYQYYRDFAEN
          |||||||||||||||||||||||| ||||||||||||||||||||||||||||||||||||
orf1a     MKTTDKRTTETHRKAPKTGRIRFSPAYLAICLSFGILPQAWAGHTYFGINYQYYRDFAEN
                10         20         30         40         50         60

70         80         90        100        110        120
orf1.pep  KGKFAVGAKDIEVYNKKGELVGKSMTKAPMIDFSVVSRNGVAALVGVQYIVSVAHNGGYN
          ||||||||||||||||||||||||||||||||||||||||||||| ||||||||||||||
orf1a     KGKFAVGAKDIEVYNKKGELVGKSMTKAPMIDFSVVSRNGVAALVGDQYIVSVAHNGGYN
                70         80         90        100        110        120
```

```
                         -continued
                 130       140       150       160       170       180
orf1.pep    NVDFGAEGXNIXDQXRXTYKIVKRNNYKAGTKGHPYGGDYHMPRLHKXVTDAEPVEMTSY
            ||||||||||  ||  :|:|||||||   ::  |||:|| |||||| ||||||||||||
orf1a       NVDFGAEGXN-PDQHRFSYQIVKRNNYKPDNS-HPYNGDXHMPRLHKFVTDAEPVEMTSD
                 130       140       150       160       170

190       200       210
orf1.pep    MDGRKYIDQNNYPDRVRIGAGRQYWRSDEDEP---------------------NN-----
            ||   |  :::||||||:|::|||   |:|:                       ||
orf1a       MRGNTYSDKEKYPERVRIGSGHHYWRYDDDKHGDLSYSGAWLIGGNTHMQGWGNNGVXSL
            180       190       200       210       220       230

220               230       240       250       260
orf1.pep    ----RESSYH----IA-----SGSPMFIYDAQKQKWLINGVLQTGNPYIGKSNGFQLVRK
                :::  :    ||      ||||||||||  ::|:||||||| || |: ||||||:||
orf1a       SGDVRHANDYGPMPIAGAAGDSGSPMFIYDKTNNKWLLNGVLQTGYPYSGRENGFQLIRK
            240       250       260       270       280       290

270       280       290       300       310       320
orf1.pep    DWFYDEIFAGDTHSVFYEPRQNGKYSFNDDNNGTGKINAKHEHNSLPNRLKTRTVQLFNV
            |||||:|   ||||   |:||:||||::|||||   ::  :|:  |   | ||::|:|:
orf1a       DWFYDDIYRGDTHTVXFEPRSNGHFSFTSNNNGTGTVTETNEKVSNP-KLKVQTVRLFDE
            300       310       320       330       340       350

330       340       350       360       370       380
orf1.pep    SLSETAREPVYHAAGGVNSYRPRLNNGENISFIDEGKGELILTSNINQGAGGLYFQGDFT
            ||:|| :|||| ||||||:||||||||||:||| |||:| |::::||||||||| ||||
orf1a       SLNETDKEPVY-AAGGVNQYRPRLNNGENLSFIDYGNGKLILSNNINQGAGGLYFEGDFT
            360       370       380       390       400       410

390       400       410       420       430
orf1.pep    VSPENNETWQGAGVHISEDSTVTWKVNGVANDRLSKIGKGTL-------------------
            ||||||||||||||||||||||||||||||||||||||||||
orf1a       VSPENNETWQGAGVHISEDSTVTWKVNGVANDRLSKIGKGTLHVQAKGENQGSISVGDGT
            420       430       440       450       460       470 orf1.pep    ------------------------------------------------------------ orf1a       VILDQQADDKGKKQAFSEIGLXSGRGTVQLNADNQFNPDKLYFGFRGGRLDLNGHSLSFH
            480       490       500       510       520       530 orf1.pep    ------------------------------------------------------------ orf1a       RIQNTDEGAMIXXHNATTTSTVTITGNESITQPSGKNINRLNYSKEIAYNGWFGEKDTTK
            540       550       560       570       580       590 orf1.pep    ------------------------------------------------------------ orf1a       TNGRLNLVYQPAAEDRTXLLSGGTNLNGNITQTNGKLFFSGRPTPHAYNHLGSGWSKMEG
            600       610       620       630       640       650 orf1.pep    ------------------------------------------------------------ orf1a       IPQGEIVWDNDWIXRTFKAENFHIQGGQAVISRNVAKVEGDXHLSNHAQAVFGVAPHQSH
            660       670       680       690       700       710

440       450       460       470       480
orf1.pep    ---------------XXXXXDKVTASLTKTDISGNVDLADHAHLNLTGLATLNGNLSAN
                           :  || : |||  ||||||||  |:| ||||||
orf1a       TICTRSDWTGLTNCVEXXITDDKVIASLTKTDXSGXVXLXXXXXXXLXGXAXLXGNLSAN
            720       730       740       750       760       770

490       500       510       520       530       540
orf1.pep    GDTRYTVSHNATQNGNXSLVXNAQATFNQATLNGNTSASGNASFNLSDHAVQNGSLTLSG
            |||||||||||||||| |||  |||||||||||||: ||||||||||::|: |||||| 
orf1a       GDTRYTVSHNATQNGNLSLVGNAQATFNQATLNGNXSXSGNASFNLSNNAAQNGSLTLSD
            780       790       800       810       820       830

550       560       570       580       590       600
orf1.pep    NAKANVSHSALNGNVSLADKAVFHFESSRFTGQISGGKDTALHLKDSEWTLPSGXELGNL
            ||||||||||||||||||||||||||:|||||| ||| | |||||||||||||| ||||
orf1a       NAKANVSHSALNGNVSLADKAVFHFENSRFTGQLSGSKXTALHLKDSEWTLPSGTELGNL
            840       850       860       870       880       890

610       620       630       640       650       660
orf1.pep    NLDNATITLNSAYRHDAAGAQTGSATDAPRRRSRRSRRSLLXVTPPTSVESRFNTLTVNG
            ||||||||||||||||||||||| ::: :|||||||||   ||||||||||||||||||
orf1a       NLDNATITLNSAYRHDAAGAQTGXVSDTPRRRSRRSRRS---LLSVTPPTSVESRFNTLTVNG
            900       910       920       930            940       950

670       680       690       700       710       720
orf1.pep    KLNGQGTFRFMSELFGYRSDKLKLAESSEGTYTLAVNNTGNEPASLEQTVVEGKDNKPL
            |||  ||||||||||||||||||||||||||||||||||||||:|| ||||||||||||
orf1a       KLNXQGTFRFMSELFGYRSDKLKLAESSEGTYTLAVNNTGNEPVSLDQLTVVEGKDNKPL
            960       970       980       990       1000      1010

730       740       750
orf1.pep    SENLNFTLQNEHVDAGAW------------------------------------------
            ||||||||||||||||||
orf1a       SENLNFTLQNEHVDAGAWRYQLIRKDGEFRLHNPVKEQELSDKLGKAEAKKQAEKDNAQS
            1020      1030      1040      1050      1060      1070
```

```
                             -continued
orf1.pep     ------------------------------------------------------------
orf1a        LDALIAAGRDAAEKTESVAEPARXAGGENVGIMQAEEEKKRVQADKDSALAKQREAETRP
                  1080      1090      1100      1110      1120      1130
                                                                   760
orf1.pep     ---------------------------------------------------------LDR
                                                                    |||
orf1a        XTTAFPRARXARRDLPQPQPQPQPQPQPQRDLXSRYANSGLSEFSATLNSVFAVQDELDR
                  1140      1150      1160      1170      1180      1190
             770       780       790       800       810       820
orf1.pep     VFAEDRRNAVWTSGIRDTKHYRSQDFRAYRQQTDLRQIGMQKNLGSGRVGILFSHNRTEN
             ||||||||||||||| ||| ||||||||||||||||||||||||||||||||||||||||
orf1a        VFAEDRRNAVWTSXIRXTKHYRSQDFRAYRQQTDLRQIGMQKNLGSGRVGILFSHNRTEN
                  1200      1210      1220      1230      1240      1250
             830       840       850       860       870       880
orf1.pep     TFDDGIGNSARLAHGAVFGQYGIDRFYIGISAGAGFSSGSLSDGIGXKRRRVLHYGIQA
             :|||||||||||||||||||||||:|||||||:|||||||| ||||||||| |||||||||
orf1a        XFDDGIGNSARLAHGAVFGQYGIGRFDIGISTGAGFSSGXLSDGIGGKIRRRVLHYGIQA
                  1260      1270      1280      1290      1300      1310
             890       900       910       920       930       940
orf1.pep     RYRAGFGGFGIEPHIGATRYFVQKADYRYENVNIATPGLAFNRYAGIKADYSFKPAQHI
             |||||||||||||:|||||||||||||||||||||||||||||||||||||||||||||
orf1a        RYRAGFGGFGIEPYIGATRYFVQKADYRYENVNIATPGLAFNRYAGIKADYSFKPAQHX
                  1320      1330      1340      1350      1360      1370
             950       960       970       980       990       1000
orf1.pep     SITPYLSLSYTDAASGKVRTRVNTAVLAQDFGKTRSAEWGVNAEIKGFTLSLHAAAAKGP
             |||||| |||||||||||||||||||||||||||||||||||||||||||||||||||
orf1a        SITPYXSLSYTDAASGKVRTRVNTAVLAQDFGKTRSAEWGVNAEIKGFTLSXHAAAAKGP
                  1380      1390      1400      1410      1420      1430
             1010      1020
orf1.pep     QLEAQHSAGIKLGYRWX
             |||||||||||||||||
orf1a        QLEAQHSAGIKLGYRWX
                  1440      1450
```

The complete length ORF1a nucleotide sequence <SEQ ID 651> is:

```
   1  ATGAAAACAA CCGACAAACG GACAACCGAA ACACACCGCA
      AAGCCCCGAA

51  AACCGCCCGC ATCCGCTTCT CGCCTGCTTA CTTAGCCATA
      TGCCTGTCGT

101  TCGGCATTCT TCCCCAAGCT TGGGCGGGAC ACACTTATTT
      CGGCATCAAC

151  TACCAATACT ATCGCGACTT TGCCGAAAAT AAAGGCAAGT
      TTGCAGTCGG

201  GGCGAAAGAT ATTGAGGTNT ACAACAAAAA AGGGGAGTTG
      GTCGGCAAAT

251  CAATGACAAA AGCCCCGATG ATTGATTTTT CTGTGGTGTC
      GCGTAACGGC

301  GTGGCGGCAT TGGTGGGCGA TCAATATATT GTGAGCGTGG
      CACATAACGG

351  CGGCTATAAC AACGTTGATT TTGGTGCGGA AGGAAGNAAT
      CCCGATCAGC

401  ACCGTTTTTC TTACCAAATT GTGAAAAGAA ATAATTATAA
      GCCTGACAAT

451  TCACACCCTT ACAACGGCGA TTANCATATG CCGCGTTTGC
      ATAAATTTGT

501  CACAGATGCA GAACCTGTCG AAATGACGAG TGACATGAGG
      GGGAATACCT

551  ATTCCGATAA AGAAAAATAT CCCGAGCGTG TCCGCATCGG
      CTCAGGACAC

601  CACTATTGGC GTTATGATGA TGACAAACAC GGCGATTTAT
      CCTACTCCGG

651  CGCATGGTTA ATTGGCGGCA ATACACATAT GCAGGGTTGG
      GGAAATAATG

701  GCGTANTTAG TTTGAGCGGC GATGTGCGCC ATGCCAACGA
      CTATGGCCCT

751  ATGCCGATTG CAGGTGCGGC AGGCGACAGC GGTTCGCCAA
      TGTTTATTTA

801  TGACAAAACA AACAATAAAT GGCTGCTCAA CGGAGTTTTA
      CAAACCGGCT

851  ACCCTTATTC CGGCAGGGAA AACGGTTTCC AGCTGATACG
      CAAAGATTGG

901  TTCTACGATG ACATTTACAG AGGCGATACA CATACCGTCT
      NTTTTGAACC

951  GCGCAGTAAC GGACATTTTT CCTTTACATC CAACAACAAC
      GGTACGGGTA

1001  CGGTAACAGA AACCAACGAA AAGGTNTCCA ATCCAAAGCT
      TAAAGTACAG

1051  ACAGTCCGAC TGTTTGACGA ATCTTTGAAT GAAACTGATA
      AAGAACCAGT

1101  TTACGCGGCA GGGGGTGTTA ATCAGTACCG TCCAAGGTTA
      AACAACGGTG

1151  AAAACCTTTC TTTTATCGAT TACGGCAACG GCAAACTCAT
      CTTATCAAAC

1201  AACATCAACC AAGGCGCGGG CGGTTTGTAT TTTGAAGGTG
      ATTTTACGGT
```

```
1251 CTCGCCTGAA AACAACGAAA CGTGGCAAGG CGCGGGCGTT
     CATATCAGTG
1301 AAGACAGTAC CGTTACTTGG AAAGTAAACG GCGTGGCAAA
     CGACCGCCTG
1351 TCCAAAATCG GCAAAGGCAC GCTGCACGTT CAAGCCAAAG
     GGGAAAACCA
1401 AGGCTCGATC AGCGTGGGCG ACGGTACAGT CATTTTGGAT
     CAGCAGGCAG
1451 ACGATAAAGG CAAAAAACAA GCCTTTAGTG AAATCGGCTT
     GNTCAGCGGC
1501 AGGGGTACGG TGCAACTGAA TGCCGATAAT CAGTTCAACC
     CCGACAAACT
1551 CTATTTCGGC TTTTCGCGGCG GACGTTTGGA TTTAAACGGG
     CATTCGCTTT
1601 CGTTCCACCG TATTCAAAAT ACCGATGAAG GGGCGATGAT
     TGNCNATCAT
1651 AATGCCACAA CAACATCCAC CGTTACCATT ACAGGGAATG
     AAAGTATTAC
1701 ACAACCGAGT GGTAAGAATA TCAATAGACT TAATTACAGC
     AAAGAAATTG
1751 CCTACAACGG TTGGTTTGGC GAGAAAGATA CGACCAAAAC
     GAACGGGCGG
1801 CTCAACCTTG TTTACCAGCC CGCCGCAGAA GACCGCACCC
     NGCTGCTTTC
1851 CGGCGGAACA AATTTAAACG GCAACATCAC GCAAACAAAC
     GGCAAACTGT
1901 TTTTCAGCGG CAGACCGACA CCGCACGCCT ACAATCATTT
     AGGAAGCGGG
1951 TGGTCAAAAA TGGAAGGTAT CCCACAAGGA CAAATCGTGT
     GGGACAACGA
2001 CTGGATCNAC CGCACGTTTA AAGCGGAAAA TTTCCATATT
     CAGGGCGGGC
2051 AGGCGGTGAT TTCCCGCAAT GTTGCCAAAG TGGAAGGCGA
     TTGNCATTTG
2101 AGCAATCACG CCCAAGCAGT TTTTGGTGTC GCACCGCATC
     AAAGCCTAC
2151 AATCTGTACA CGTTCGGACT GGACNGGTCT GACAAATTGT
     GTCGAANAAA
2201 NCATTACCGA CGATAAAGTG ATTGCTTCAT TGACTAAGAC
     NGACNTNAGC
2251 GGCANTGTNA GNCTNNCCNA TNACGNTNNT TNAAANCTCN
     CNGGGCNTGC
2301 NNCACTNAAN GGCAATCTTA GTGCAAATGG CGATACACGT
     TATACAGTCA
2351 GCCACAACGC CACCCAAAAC GGCAACCTTA GCCTCGTGGG
     CAATGCCCAA
2401 GCAACATTTA ATCAAGCCAC ATTAAACGGC AACNCATCGG
     NTTCGGGCAA
2451 TGCTTCATTT AATCTAAGCA CAACGCCGC ACAAAACGGC
     AGTCTGACGC
2501 TTTCCGACAA CGCTAAGGCA AACGTAAGCC ATTCCGCACT
     CAACGGCAAT
2551 GTCTCCCTAG CCGATAAGGC AGTATTCCAT TTTGAAAACA
     GCCGCTTTAC
2601 CGGACAACTC AGCGGCAGCA AGGANACAGC ATTACACTTA
     AAAGACAGCG
2651 AATGGACGCT GCCGTCAGGC ACGGAATTAG GCAATTTAAA
     CCTTGACAAC
2701 GCCACCATTA CACTCAATTC CGCCTATCGC CACGATGCTG
     CAGGCGCGCA
2751 AACCGGCAGN GTGTCAGACA CGCCGCGCCC CCGTTCGCGC
     CGTTCCCTAT
2801 TATCCGTTAC ACCGCCAACT TCGGTAGAAT CCCGTTTCAA
     CACGCTGACG
2851 GTAAACGGCA AATTGAACNG TCAAGGAACA TTCCGCTTTA
     TGTCGGAACT
2901 CTTCGGCTAC CGAAGCGACA AATTGAAGCT GGCGGAAAGT
     TCCGAAGGNA
2951 CTTACACCTT GGCGGTCAAC AATACCGGCA ACGAACCCGT
     AAGCCTCGAT
3001 CAATTGACGG TAGTGGAAGG GAAAGACAAC AAACCGCTGT
     CCGAAAACCT
3051 TAATTTCACC CTGCAAAACG AACACGTCGA TGCCGGCGCG
     TGGCGTTACC
3101 AACTCATCCG CAAAGACGGC GAGTTCCGCC TGCATAATCC
     GGTCAAAGAA
3151 CAAGAGCTTT CCGACAAACT CGGCAAGGCA GAAGCCAAAA
     AACAGGCGGA
3201 AAAAGACAAC GCGCAAAGCC TTGACGCGCT GATTGCGGCC
     GGGCGCGATG
3251 CCGCCGAAAA GACAGAAAGC GTTGCCGAAC CGGCCCGGCN
     GGCAGGCGGG
3301 GAAAATGTCG GCATTATGCA GGCGGAGGAA GAGAAAAAAC
     GGGTGCAGGC
3351 GGATAAAGAC AGCGCNTTGG CGAAACAGCG CGAAGCGGAA
     ACCCGGCCGG
3401 NTACCACCGC CTTCCCCCGC GCCCGCNGCG CCCGCCGGGA
     TTTGCCGCAA
3451 CCGCAGCCCC AACCGCAACC TCAACCCCAA CCGCAGCGCG
     ACCTGATNAG
3501 CCGTTATGCC AATAGCGGTT TGAGTGAATT TTCCGCCACG
     CTCAACAGCG
3551 TTTTCGCCGT ACAGGACGAA TTGGACCGCG TGTTTGCCGA
     AGACCGCCGC
3601 AACGCNGTTT GGACAAGCNG CATCCGGNAC ACCAAACACT
     ACCGTTCGCA
3651 AGATTTCCGC GCCTACCGCC AACAAACCGA CCTGCGCCAA
     ATCGGTATGC
3701 AGAAAAACCT CGGCAGCGGG CGCGTCGGCA TCCTGTTTTC
     GCACAACCGG
3751 ACCGAAAACA NCTTCGACGA CGGCATCGGC AACTCGGCAC
     GGCTTGCCCA
3801 CGGCGCCGTT TTCGGGCAAT ACGGCATCGG CAGGTTCGAC
     ATCGGCATCA
3851 GCACGGGCGC GGGTTTTAGC AGCGGCANTC TNTCAGACGG
     CATCGGAGGC
```

```
3901 AAAATCCGCC GCCGCGTGCT GCATTACGGC ATTCAGGCAC
     GATACCGCGC

3951 CGGTTTCGGC GGATTCGGCA TCGAACCGTA CATCGGCGCA
     ACGCGCTATT

4001 TCGTCCAAAA AGCGGATTAC CGCTACGAAA ACGTCAATAT
     CGCCACCCCC

4051 GGTCTTGCGT TCAACCGNTA CCGNGCGGGC ATTAAGGCAG
     ATTATTCATT

4101 CAAACCGGCG CAACACATNT CCATCACNCC TTATTTNAGC
     CTGTCCTATA

4151 CCGATGCCGC TTCGGGCAAA GTCCGAACAC GCGTCAATAC
     CGCNGTATTG

4201 GCTCAGGATT TCGGCAAAAC CCGCAGTGCG GAATGGGGCG
     TAAACGCCGA

4251 AATCAAAGGT TTCACGCTGT CCNTCCACGC TGCCGCCGCC
     AAAGGNCCGC

4301 AACTGGAAGC GCAACACAGC GCGGGCATCA AATTAGGCTA
     CCGCTGGTAA
```

This encodes a protein having amino acid sequence <SEQ ID 652>:

```
  1 MKTTDKRTTE THRKAFKTGR IRFSPAYLAI CLSFGILPQA
    WAGHTYFGIN

51 YQYYRDFAEN KGKFAVGAKD IEVYNKKGEL VGKSMTKAPM
    IDFSVVSRNG

101 VAALVGDQYI VSVAHNGGYN NVDFGAEGXN PDQHRFSYQI
    VKRNNYKFDN

151 SHPYNGDXHM PRLHKFVTDA EPVEMTSDMR GNTYSDKEKY
    PERVRIGSGH

201 HYWRYDDDKH GDLSYSGAWL IGGNTHMQGW GNNGVXSLSG
    DVRHANDYGP

251 MPIAGAAGDS GSPMFIYDKT NNKWLLNGVL QTGYPYSGRE
    NGFQLIRKDW

301 FYDDIYRGDT HTVXFEPRSN GHFSFTSNNN GTGTVTETNE
    KVSNPKLKVQ

351 TVRLFDESLN ETDKEPVYAA GGVNQYRPRL NNGENLSFID
    YGNGKLILSN

401 NINQGAGGLY FEGDFTVSPE NNETWQGAGV HISEDSTVTW
    KVNGVANDRL

451 SKIGKGTLHV QAKGENQGSI SVGDGTVILD QQADDKGKKQ
    AFSEIGLXSG
```

```
501 RGTVQLNADN QFNPDKLYFG FRGGRLDLNG HSLSFHRIQN
    TDEGAMIXXH

551 NATTTSTVTI TGNESITQPS GKNINRLNYS KEIAYNGWFG
    EKDTTKTNGR

601 LNLVYQPAAE DRTXLLSGGT NLNGNITQTN GKLFFSGRPT
    PHAYNHLGSG

651 WSKMEGIPQG EIVWDNDWIX RTFKAENFHI QGGQAVISRN
    VAKVEGDXHL

701 SNHAQAVFGV APHQSHTICT RSDWTGLTNC VEXXITDDKV
    IASLTKTDXS

751 GXVXLXXXXX XXLXGXAXLX GNLSANGDTR YTVSHNATQN
    GNLSLVGNAQ

801 ATFNQATLNG NXSXSGNASF NLSNNAAQNG SLTLSDNAKA
    NVSHSALNGN

851 VSLADKAVFH FENSRFTGQL SGSKXTALHL KDSEWTLPSG
    TELGNLNLDN

901 ATITLNSAYR HDAAGAQTGX VSDTPRRRSR RSLLSVTPPT
    SVESRFNTLT

951 VNGKLNXQGT FRFMSELFGY RSDKLKLAES SEGTYTLAVN
    NTGNEPVSLD

1001 QLTVVEGKDN KPLSENLNFT LQNEHVDAGA WRYQLIRKDG
     EFRLHNPVKE

1051 QELSDKLGKA EAKKQAEKDN AQSLDALIAA GRDAAEKTES
     VAEPARXAGG

1101 ENVGIMQAEE EKKRVQADKD SALAKQREAE TRPXTTAFPR
     ARXARRDLPQ

1151 PQPQPQPQPQ PQRDLXSRYA NSGLSEFSAT LNSVFAVQDE
     LDRVFAEDRR

1201 NAVWTSXIRX TKHYRSQDFR AYRQQTDLRQ IGMQKNLGSG
     RVGILFSHNR

1251 TENXFDDGIG NSARLAHGAV FGQYGIGRFD IGISTGAGFS
     SGXLSDGIGG

1301 KIRRRVLHYG IQARYRAGFG GFGIEPYIGA TRYFVQKADY
     RYENVNIATP

1351 GLAFNRYRAG IKADYSFKPA QHXSITPYXS LSYTDAASGK
     VRTRVNTAVL

1401 AQDFGKTRSA EWGVNAEIKG FTLSXHAAAA KGPQLEAQHS
     AGIKLGYRW*
```

A transmembrane region is underlined.

ORF1-1 shows 86.3% identity over a 1462aa overlap with ORF1a:

```
                    10         20         30         40         50         60
orf1a.pep MKTTDKRTTETHRKAPKTGRIRFSPAYLAICLSFGILPQAWAGHTYFGINYQYYRDFAEN
          ||||||||||||||||||||||||||||||||||||||||||||||||||||||||||||
  orf1-1  MKTTDKRTTETHRKAPKTGRIRFSPAYLAICLSFGILPQAWAGHTYFGINYQYYRDFAEN
                    10         20         30         40         50         60

70         80         90        100        110        120
orf1a.pep KGKFAVGAKDIEVYNKKGELVGKSMTKAPMIDFSVVSRNGVAALVGDQYIVSVAHNGGYN
          ||||||||||||||||||||||||||||||||||||||||||||||||||||||||||||
  orf1-1  KGKFAVGAKDIEVYNKKGELVGKSMTKAPMIDFSVVSRNGVAALVGDQYIVSVAHNGGYN
                    70         80         90        100        110        120
```

-continued

```
              130       140       150       160       170       180
orf1a.pep  NVDFGAEGXNPDQHRFSYQIVKRNNYKPDNS-HPYNGDXHMPRLHKFVTDAEPVEMTSDM
           |||||||| ||||||| :|:||||||||    ::  |||:|| ||||||||||||||| |
orf1-1     NVDFGAEGRNPDQHRFTYKIVKRNNYKAGTKGHPYGGDYHMPRLHKFVTDAEPVEMTSYM
              130       140       150       160       170       180

180       190       200       210       220       230
orf1a.pep  RGNTYSDKEKYPERVRIGSGHHYWRYDDDKHGDL--SYSGA----WLIGGNTHMQGWGNN
           |  |   |::|||||||:|::|||  |:|  ::    ||  |   ||:||||  |: :::
orf1-1     DGRKYIDQNNYPDRVRIGAGRQYWRSDEDEPNNRESSYHIASAYSWLVGGNTFAQNGSGG
              190       200       210       220       230       240

240       250       260       270       280       290
orf1a.pep  GVXSLSGD-VRHANDYGPMPIAGAAGDSGSPMFIYDKTNNKWLLNGVLQTGYPYSGRENG
           |: :|:::  ::|:    ||  | :|:|  ||||||||  |:||||||||||:|| :||
orf1-1     GTVNLGSEKIKHS-PYGFLPTGGSFGDSGSPMFIYDAQKQKWLINGVLQTGNPYIGKSNG
              250       260       270       280       290

300       310       320       330       340       350
orf1a.pep  FQLIRKDWFYDDIYRGDTHTVXFEPRSNGHFSFTSNNNGTGTVTETNEKVSNP-KLKVQT
           |||:|||||||: | ||||:| ||||:||:||: ||:||||:|||:|:  :|: | |||
orf1-1     FQLVRKDWFYDEIFAGDTHSVFYEPRQNGKYSFNDDNNGTGKINAKHEHNSLPNRLKTRT
           300       310       320       330       340       350

360       370       380       390       400
orf1a.pep  VRLFDESLNETDKEPVY-AAGGVNQYRPRLNNGENLSFIDYGNGKLILSNNINQGAGGLY
           |:|: ||:|| || :||  |||||:|||||||||:||| ||:|:|||| ||||||||||
orf1-1     VQLFNVSLSETAREPVYHAAGGVNSYRPRLNNGENISFIDEGKGELILTSNINQGAGGLY
           360       370       380       390       400       410

420       430       440       450       460       470
orf1a.pep  FEGDFTVSPENNETWQGAGVHISEDSTVTWKVNGVANDRLSKIGKGTLHVQAKGENQGSI
           |:||||||||||||||||||||||||||||||||||||||||||||||||||||||||||
orf1-1     FQGDFTVSPENNETWQGAGVHISEDSTVTWKVNGVANDRLSKIGKGTLHVQAKGENQGSI
           420       430       440       450       460       470

480       490       500       510       520       530
orf1a.pep  SVGDGTVILDQQADDKGKKQAFSEIGLXSGRGTVQLNADNQFNPDKLYFGFRGGRLDLNG
           ||||||||||||||||||||||||||||||||||||||||||||||||||||||||||||
orf1-1     SVGDGTVILDQQADDKGKKQAFSEIGLXSGRGTVQLNADNQFNPDKLYFGFRGGRLDLNG
           480       490       500       510       520       530

540       550       560       570       580       590
orf1a.pep  HSLSFHRIQNTDEGAMIXXHNATTTSTVTITGNESITQPSGKNINRLNYSKEIAYNGWRG
           |||||||||||||||| |    ||  ||||||||:: |:  :|:|  : ||||||||||
orf1-1     HSLSFHRIQNTDEGAMIVNHNQDKESTVTITGNKDIAT-TGNN-NSLDSKKEIAYNGWRG
           540       550       560       570       580       590

600       610       620       630       640       650
orf1a.pep  EKDTTKTNGRLNLVYQPAAEDRTXLLSGGTNLNGNITQTNGKLFFSGRPTPHAYNHLGSG
           ||||||||||||||||||||||||:|||||||||||||||||||||||||||||||| ::
orf1-1     EKDTTKTNGRLNLVYQPAAEDRTLLLSGGTNLNGNITQTNGKLFFSGRPTPHAYNHLNDH
           600       610       620       630       640       650

660       670       680       690       700       710
orf1a.pep  WSKMEGIPQGEIVWDNDWIXRTFKAENFHIQGGQAVISRNVAKVEGDXHLSNHAQAVFGV
           ||: ||||:|||||||||| ||||||||:| |||||:|||||||:| |||||||||||||
orf1-1     WSQKEGIPRGEIVWDNDWINRTFKAENFQIKGGQAVVSRNVAKVKGDWHLSNHAQAVFGV
           660       670       680       690       700       710

720       730       740       750       760       770
orf1a.pep  APHQSHTICTRSDWTGLTNCVEXXITDDKVIASLTKTDXSGXVXLXXXXXXXLXGXAXLX
           |||||||||||||||||||||| :|||||||||||||| :|  |       |:|  |:|
orf1-1     APHQSHTICTRSDWTGLTNCVEKTITDDKVIASLTKTDISGNVDLADHAHLNLTGLATLN
           720       730       740       750       760       770

780       790       800       810       820       830
orf1a.pep  GNLSANGDTRYTVSHNATQNGNLSLVGNAQATFNQATLNGNXSXSGNASFNLSNNAAQNG
           ||||||||||||||||||||||||||||||||||||||||| :| |||||||:::|:|||
orf1-1     GNLSANGDTRYTVSHNATQNGNLSLVGNAQATFNQATLNGNTSASGNASFNLSDHAVQNG
           780       790       800       810       820       830

840       850       860       870       880       890
orf1a.pep  SLTLSDNAKANVSHSALNGNVSLADKAVFHFENSRFTGQLSGSKXTALHLKDSEWTLPSG
           ||||:|:|||||||||||||||||||||||||:||||||:|| |: |||||||||||||
orf1-1     SLTLSGNAKANVSHSALNGNVSLADKAVFHFESSRFTGQISGGKDTALHLKDSEWTLPSG
           840       850       860       870       880       890

900       910       920       930       940
orf1a.pep  TELGNLNLDNATITLNSAYRHDAAGAQTGXVSDTPRRRSRRS---LLSVTPPTSVESRFN
           |||||||||||||||||||||||||||||:|: ||||||||    ||||||||||||||
orf1-1     TELGNLNLDNATITLNSAYRHDAAGAQTGSATDAPRRRSRRSRRSLLSVTPPTSVESRFN
           900       910       920       930       940       950

950       960       970       980       990      1000
orf1a.pep  TLTVNGKLNXQGTFRFMSELFGYRSDKLKLAESSEGTYTLAVNNTGNEPVSLDQLTVVEG
           |||||||||  |||||||||||||||||||||||||||||||||||||| :|:||||||
orf1-1     TLTVNGKLNGQGTFRFMSELFGYRSDKLKLAESSEGTYTLAVNNTGNEPASLEQLTVVEG
           960       970       980       990      1000      1010

1010      1020      1030      1040      1050      1060
orf1a.pep  KDNKPLSENLNFTLQNEHVDAGAWRYQLIRKDGEFRLHNPVKEQELSDKLGKAEAKKQAE
           ||||||||||||||||||||||||||||||||||||||||||||||||||||||||||||
orf1-1     KDNKPLSENLNFTLQNEHVDAGAWRYQLIRKDGEFRLHNPVKEQELSDKLGKAEAKKQAE
           1020      1030      1040      1050      1060      1070
```

```
                   1070        1080        1090        1100        1110        1120
      orf1a.pep    KDNAQSLDALIAAGRDAAEKTESVAEPARXAGGENVGIMQAEEEKKRVQADKDSALAKQR
                   ||||||||||||||||||||:||||||||||| |||||||||||||||||||||:||||||
      orf1-1       KDNAQSLDALIAAGRDAVEKTESVAEPARQAGGENVGIMQAEEEKKRVQADKDTALAKQR
                   1080        1090        1100        1110        1120        1130

1130        1140        1150        1160        1170        1180
      orf1a.pep    EAETRPXTTAFPRARXARRDLPQPQPQPQPQPQPQRDLXSRYANSGLSEFSATLNSVFAV
                   ||||||  ||||||||| |||||||||||||       ||| ||||||||||||||||||
      orf1-1       EAETRPATTAFPRARRARRDLPQLQPQPQPQP--QRDLISRYANSGLSEFSATLNSVFAV
                   1140        1150        1160        1170        1180        1190

1190        1200        1210        1220        1230        1240
      orf1a.pep    QDELDRVFAEDRRNAVWTSXIRXTKHYRSQDFRAYRQQTDLRQIGMQKNLGSGRVGILFS
                   |||||||||||||||||||| || |||||||||||||||||||||||||||||||||||
      orf1-1       QDELDRVFAEDRRNAVWTSGIRDTKHYRSQDFRAYRQQTDLRQIGMQKNLGSGRVGILFS
                   1200        1210        1220        1230        1240        1250

1250        1260        1270        1280        1290        1300
      orf1a.pep    HNRTENXFDDGIGNSARLAHGAVFGQYGIGRFDIGISTGAGFSSGXLSDGIGGKIRRRVL
                   ||||||:||||||||||||||||||||||  ||:|||| |||||||||||||||||||||
      orf1-1       HNRTENTRDDGIGNSARLAHGAVFGQYGIDRFYIGISAGAGFSSGSLSDGIGGKIRRRVL
                   1260        1270        1280        1290        1300        1310

1310        1320        1330        1340        1350        1360
      orf1a.pep    HYGIQARYRAGFGGFGIEPYIGATRYFVQKADYRYENVNIATPGLAFNRYRAGIKADYSF
                   ||||||||||||||||||||:|||||||||||||||||||||||||||||||||||||||
      orf1-1       HYGIQARYRAGFGGFGIEPHIGATRYFVQKADYRYENVNIATPGLAFNRYRAGIKADYSF
                   1320        1330        1340        1350        1360        1370

1370        1380        1390        1400        1410        1420
      orf1a.pep    KPAQHXSITPYXSLSYTDAASGKVRTRVNTAVLAQDFGKTRSAEWGVNAEIKGFTLSXHA
                   |||||  |||||| ||||||||||||||||||||||||||||||||||||||||||| ||
      orf1-1       KPAQHISITPYLSLSYTDAASGKVRTRVNTAVLAQDFGKTRSAEWGVNAEIKGFTLSLHA
                   1380        1390        1400        1410        1420        1430

1430        1440        1450
      orf1a.pep    AAAKGPQLEAQGSAGIKLGYRWX
                   |||||||||||||||||||||||
      orf1-1       AAAKGPQLEAQGSAGIKLGYRWX
                   1440        1450
```

Homology with Adhesion and Penetration Protein Hap Precursor of *H. influenzae* (Accession Number P45387)

Amino acids 23-423 of ORF1 show 59% aa identity with hap protein in 450aa overlap:

```
orf1    23 FXAAYLAICLSFGILPQAWAGHTYFGINYQYYRDFAENKGKFAVGAKDIEVYNKKGELVG    82
              F   +L  C+S GI  QAWAGHTYFGI+YQYYRDFAENKGKF VGAK+IEVYNK+G+LVG
hap      6 FRLNFLTACVSLGIASQAWAGHTYFGIDYQYYRDFAENKGKFTVGAKNIEVYNKEGQLVG    65 orf1    83 KSMTKAPMIDFSVVSRNGVAALGVQYIVSVAHNGGYNNVDFGAEGXNIXDQXRXTYKIV    142
              SMTKAPMIDFSVVSRNGVAALVG QYIVSVAHNGGYN+VDFGAEG N  DQ R  TY+IV
hap     66 TSMTKAPMIDFSVVSRNGVAALVGDQYIVSVAHNGGYNDVDFGAEGRN-PDQHRFTYQIV   124 orf1   143 KRNNYKAGTKGHPYGGDYHMPRLHKXVTDAEPVEMTSYMDGRKYIDQNNYPDRVRIGAGR   202
              KRNNY+A   + HPY GDYHMPRLHK VT+AEPV MT+ MDG+ Y D+ NYP+RVRIG+GR
hap    125 KRNNYQAWERKHPYDGDYHMPRLHKFVTEAEPVGMTTNMDGKVYADRENYPERVRIGSGR   184 orf1   203 QYWRSDEDEPNNRESSYHIA----------------------------------------   222
              QYWR+D+DE  N  SSY+++
hap    185 QYWRTDKDEETNVHSSYYVSGAYRYLTAGNTHTQSGNGNGTVNLSGNVVSPNHYGPLPTG   244 orf1   223 -----SGSPMFIYDAQKQKWLINGVLQTGNPYIGKSNGFQLVRKDWFYDEIFAGDTHSVF   277
                   SGSPMFIYDA+K++WLIN VLQTG+P+ G+ NGFQL+R++WFY+E+ A DT SVF
hap    245 GSKGDSGSPMFIYDAKKKQWLINAVLQTGHPFFGRGNGFQLIREEWFYNEVLAVDTPSVF   304 orf1   278 --YEPRQNGKYSFNDDNNGTGKIN-AKHEHNSLPNRLKTRTVQLFNVSLSETAREPVYHA   334
                Y P NG YSF +N+GTGK+   +     +  + +   TV+LFN SL++TA+E V  A
hap    305 QRYIPPINGHYSFVSNNDGTGKLTLTRPSKDGSKAKSEVGTVKLFNPSLNQTAKEHV-KA   363 orf1   335 AGGVNSYRPRLNNGENISFIDEGKGELILTSNINQGAGGLYFQGDFTV-SFENNETWQGA   393
              A G N Y+PR+  G+NI  D+KG L + +NINQGAGGLYF+G+F V    +NN TWQGA
hap    364 AAGYNIYQPRMEYGKNIYLGDQGKGTLTIENNINQGAGGLYFEGNFVVKGKQNNTTWQGA   423 orf1   394 GVHISEDSTVTWKVNGVANDRLSKIGKGTL                                423
              GV I +D+TV WKV+   NDRLSKIG GTL
hap    424 GVSIGQDATVEWKVHNPENDRLSKIGIGTL                                453
```

Amino acids 715-1011 of ORF1 show 50% aa identity with hap protein in 258aa overlap:

```
Orf1   41 DTRYTVSHNATQ-NGNXSLVXNAQATFNQ-ATLNGNTSASGNASFNLSDHAVQNGSLTLS   98
          DT+      S   TQ NG+ +L  NA   +  A LNGN +   ++F LS++A Q G++LS
hap   733 DTKVINSIPITQINGSINLTNNATVNIHGLAKLNGNVTLIDHSQFTLSNNATQTGNIKLS   792 orf1   99 GNAKANVSHSALNGNVSLADKAVFHFESSRETGQISGGKDTALHLKDSEWTLPSGXELGN   158
          +A A V+++ LNGNV L D A F  ++S F  QI G KDT + L+++WT+PS    L N
hap   793 NHANATVNNATLNGNVHLTDSAQFSLKNSHFWHQIQGDKDTTVTLENATWTMPSDTTLQN   852 orf1  159 LNLDNATITLNSAYRHDAAGAQTGSATDAPXXXXXXXXXXXLLXVTpPTSVESRFNTLTVN   218
          L L+N+T+TLNSAY       + S+ +AP           L   T PTS E
                                                    RFNTLTVN
hap   853 LTLNNSTVTLNSAY--------SASSNNAPRHRRS-----LETETTPTSAEHRFNTLTVN   899 orf1  219 GKLNGQGTFRFMSELFGYRSDKLKLAESSEGTYTLAVNNTGNEPASLEQLTVVEGKDNKP   278
          GKL+GQGTF+F S LFGY+SDKLKL+  +EG YTL+V NTG EP +LEQLT++E  DNKP
hap   900 GKLSGQGTFQFTSSLFGYKSDKLKLSNDAEGDYTLSVRNTGKEPVTLEQLTLIESLDNKP   959 orf1  279 LSENLNFTLQNEHVDAGA                                            296
          LS+ L FTL+N+HVDAGA
hap   960 LSDKLKFTLENDHVDAGA                                            977
```

Amino acids 1192-1450 of ORF1 show 41% aa identity with hap protein in 259aa overlap:

```
Orf1     1 LDRVFAEDRRNAVWTSGIRDTKHYRSQDFRAYRQQTDLRQIGMQKNLGSGRVGILFSHNR   60
           LDR+F +  ++AVWT+  +D + Y S  FRAY+Q+T+LRQIG+QK L +GR+G +FSH+R
hap   1135 LDRLFVDQAQSAVWTNIAQDKRRYDSDAFRAYQQKTNLRQIGVQKALANGRIGAVFSHSR  1194 orf1    61 TENTFDDGIGNSARLAHGAVFGQYGIDRFYXXXXXXXXXXXXXXXXXXXIGXKXRRRVLHYG   120
           ++NTFD+ + N A L   + F QY                        K  R+ ++YG
hap   1195 SDNTFDEQVKNHATLMMSGFAQYQWGDLQFGVNVGTGISASKMAEEQSRKIHRKAINYG   1254 orf1   121 IQARYRAGFGGFGIEPHIGATRYFVQKADYRYENVNIATPGLAFNRYRAGIKADYSFKPA   180
           + A Y+   G  GI+P+ G  RYF+++ +Y+ E V + TP LAFNRY AGI+ DY+F P
hap   1255 VNASYQFRLGQLGIQPYFGVNRYFIERENYQSEEVRVKTPSLAFNRYNAGIRVDYTFTPT   1314 orf1   181 QHISITPYLSLSYTDAASGKVRTRVNTAVLAQDFGKTRSAEWGVNAEIKGFTLSLHAAAA   240
           +IS+ PY  ++Y D ++   V+T VN   VL Q FG+    E G+ AEI  F +S  + +
hap   1315 DNISVKPYFFVNYVDVSNANVQTTVNLTVLQQPFGRYWQKEVGLKAEILHFQISAFISKS   1374 orf1   241 KGPQLEAQHSAGIKLGYRW                                           259
           +G  QL  Q + G+KLGYRW
hap   1375 QGSQLGKQQNVGVKLGYRW                                          1393
```

Homology with a Predicted ORF from *N. gonorrhoeae*

The blocks of ORF1 show 83.5%, 88.3%, and 97.7% identities in 467, 298, and 259 aa overlap, respectively with a predicted ORF (ORF1ng) from *N. gonorrhoeae*:

```
orf1.pep   MKTTDKRTTETHRKAPKTGRIRFXAAYLAICLSFGILPQAWAGHTYFGINYQYYRDFAEN   60
           ||||||||||||||||||||||||  |||||||||||||| |||||||||||||||||||
orf1ng     MKTTDKRTTETHRKAPKTGRIRFSPAYLAICLSFGILPQARAGHTYFGINYQYYRDFAEN   60 orf1.pep   KGKFAVGAKDIEVYNKKGELVGKSMTKAPMIDFSVVSRNGVAALVGVQYIVSVAHNGGYN   120
           |||||||||||||||||||||||||||||||||||||||||||:|  |||||||||||||
orf1ng     KGKFAVGAKDIEVYNKKGELVGKSMTKAPMIDFSVVSRNGVAALAGDQYIVSVAHNGGYN   120 orf1.pep   NVDFGAEGXNIXDQXRXTYKIVKRNNYKAGTKGHPYGGDYHMPRLHKXVTDAEPVEMTSY   180
           ||||||||| ||  : | :|||||||||||| |||||||| |||||| ||||||||||||
orf1ng     NVDFGAEGSN-PDQHRFSYQIVKRNNYKAGTNGHPYGGDYGMPRLHKFVTDAEPVEMTSY   179 orf1.pep   MDGRKYIDQNNYPDRVRIGAGRQYWRSDEDEPNNRESSYHIAS----------------   223
           ||| || |  : ||||||||||||||||||||||||||||||||
orf1ng     MDGWKYADLNKYPDRVRIGAGRQYWRSDEDEPNNRESSYHIASAYSWLVGGNTFAQNGSG   239 orf1.pep   --------------------------GSPMFIYDAQKQKWLINGVLQTGNPYIGKSNG   255
                                     |||||||||||||||||| ||||||||||||
orf1ng     GGTVNLGSEKIKHSPYGFLPTGGSFGDSGSPMFIYDAQKQKWLINGVLQTGNPYIGKSNG   289 orf1.pep   FQLVRKDWFYDEIFAGDTHSVFYEPRQNGKYSFNDDNNGTKINAKHEHNSLPNRLKTRT   315
           |||||||||||||||||||||||||:|||| |||:|||:|||:|||:| ||| ||||||
orf1ng     FQLVRKDWFYDEIFAGDTHSVFYEPHQNGKYFFNDNNNGAGKIDAKHKHYSLPYRLKTRT   359
```

-continued

```
orf1.pep   VQLFNVSLSETAREPVYHAAGGVNSYRPRLNNGENISFIDEGKGELILTSNINQGAGGLY  375
           ||||||||||||||||||||||||||||||||||:|||||||||||||||||||||||||
orf1ng     VQLFNVSLSETAREPVYHAAGGVNSYRPRLNNGENISFIDKGKGELILTSNINQGAGGLY orf1.pep   FQGDFTVSPENNETWQGAGVHISEDSTVTWKVNGVANDRLSKIGKGT              422
           |:|:||||:|||||||||||||:|||||||||||||||||||||||
orf1ng     FEGNFTVSPKNNETWQGAGVHISDGSTVTWKVNGVANDRLSKIGKGTLLVQAKGENQGSV  479
                                                         // orf1.pep                   DKVTASLTKTDISGNVDLADHAHLNLTGLA               744
                           ||| |||:||| |||:|||||||||||||
orf1ng     FGVAPHQSHTICTRSDWTGLTSCTEKTITDDKVIASLSKTDVRGNVSLADHAHLNLTGLA  774 orf1.pep   TLNGNLSANGDTR-YTVSHNATQNGNXSLVXNAQATFNQATLNGNTSASGNASFNLSDHA  803
           |:||||  :::||    :  ||||||||||||||||||||||||||||||||||||::|
orf1ng     TRNGNL-VQAETRTIRLRANATQNGNLSLVGNAQATFNQATLNGNTSASDNASFNLSNNA  833 orf1.pep   VQNGSLTLSGNAKANVSHSALNGNVSLADKAVFHFESSRFTGQISGGKDTALHLKDSEWT  863
           ||||||||| ||||||||||||||||||||||||||:|||||:|||||||||||||||||
orf1ng     VQNGSLTLSDNAKANVSHSALNGNVSLADKAVFHFENSRFTGKISGGKDTALHLKDSEWT  893 orf1.pep   LPSGXELGNLNLDNATITLNSAYRHDAAGAQTGSATDAPRRRSRRSRRSLLXVTPPTSVE  923
           ||||:|||||||||||||||||||||||||||||:|||||||||   ||:||||||:||
orf1ng     LPSGTELGNLNLDNATITLNSAYRHDAAGAQTGSAADAPRRRSRRS---LLSVTPPTSAE  950 orf1.pep   SRFNTLTVNGKLNGQGTFRFMSELFGYRSDKLKLAESSEGTYTLAVNNTGNEPASLEQLT   983
           ||||||||||||||||||||||||||||||:|||||||||||||||||||||:|||||
orf1ng     SRFNTLTVNGKLNGQGTFRFMSELFGYRSGKLKLAESSEGTYTLAVNNTGNEPVSLEQLT  1010 orf1.pep   VVEGKDNKPLSENLNFTLQNEHVDAGAW                                 1011
           ||||||||:||||||||||||||||||||
orf1ng     VVEGKDNTPLSENLNFTLQNEHVDAGAWRYQLIRKDGEFRLHNPVKEQELSDKLGKAGET  1070
                                       // orf1.pep                      LDRVFAEDRRNAVWTSGIRDTKHYRSQDFR            1211
                              ||||||||||||||||||||||||||||||
orf1ng     PQRDLISRYANSGLSEFSATLNSVFAVQDELDRVFAEDRRNAVWTSGIRDTKHYRSQDFR  1239 orf1.pep   AYRQQTDLRQIGMQKNLGSGRVGILFSHNRTENTFDDGIGNSARLAHGAVFGQYGIDRFY  1271
           ||||||||||||||||||||||||||||||||:|||||||||||||||||||||| ||
orf1ng     AYRQQTDLRQIGMQKNLGSGRVGILFSHNRTGNTFDDGIGNSARLAHGAVFGQYGIGRFD  1299 orf1.pep   IGISAGAGFSSGSLSDGIGXKXRRRVLHYGIQARYRAGFGGFGIEPHIGATRYFVQKADY  1331
           |||||||||||||||||||| |||||||||||||||||||||||||||||||||||||
orf1ng     IGISAGAGFSSGSLSDGIRGKIRRRVLHYGIQARYRAGFGGFGIEPHIGATRYFVQKADY  1359 orf1.pep   RYENVNIATPGLAFNRYRAGIKADYSFKPAQHISITPYLSLSYTDAASGKVRTRVNTAVL  1391
           ||||||||||||||||||||||||||||||||||||||||||||||||||||||||||||
orf1ng     RYENVNIATPGLAFNRYRAGIKADYSFKPAQHISITPYLSLSYTDAASGKVRTRVNTAVL  1419 orf1.pep   AQDFGKTRSAEWGVNAEIKGFTLSLHAAAAKGPQLEAQHSAGIKLGYRW             1440
           |||||||||||||||||||||||||||||||||||||||||||||||||
orf1ng     AQDFGKTRSAEWGVNAEIKGFTLSLHAAAAKGPQLEAQHSAGIKLGYRW             1468
```

The complete length ORF1ng nucleotide sequence was identified <SEQ ID 653>:

```
  1 ATGAAAACAA CCGACAAACG GACAACCGAA ACACACCGCA
    AAGCCCCTAA

51 AACCGGCCGC ATCCGCTTCT CGCCCGCTTA CTTAGCCATA
    TGCCTGTCGT

101 TCGGCATTCT GCCCCAAGCC CGGGCGGGAC ACACTTATTT
    CGGCATCAAC

151 TACCAATACT ATCGCGACTT TGCCGAAAAT AAAGGCAAGT
    TTGCAGTCGG

201 GGCGAAAGAT ATTGAGGTTT ACAACAAAAA AGGGGAGTTG
    GTCGGCAAAT

251 CGATGACGAA AGCCCCGATG ATTGATTTTT CTGTGGTATC
    GCGTAACGGC

301 GTGGCGGCAT TGGCGGGCGA TCAATATATT GTGAGCGTGG
    CACATAACGG

351 CGGCTATAAC AATGTTGATT TTGGTGCGGA GGGAAGCAAT
    CCCGATCAGC

401 ACCGCTTTTC TTACCAAATT GTGAAAAGAA ATAATTATAA
    AGCAGGGACT

451 AACGGCCATC CTTATGGCGG CGATTATCAT ATGCCGCGTT
    TGCACAAATT

501 TGTCACAGAT GCAGAACCTG TTGAGATGAC CAGTTATATG
    GATGGGTGGA

551 AATACGCTGA TTTAAATAAA TACCCTGATC GTGTTCGAAT
    CGGAGCAGGC

601 AGACAATATT GGCGGTCTGA TGAAGACGAA CCCAATAACC
    GCGAAAGTTC

651 ATATCATATT GCAAGCGCAT ATTCTTGGCT CGTCGGTGGC
    AATACCTTTG

701 CACAAAATGG ATCAGGTGGT GGCACAGTCA ACTTAGGTAG
    CGAAAAAATT

751 AAACATAGCC CATATGGTTT TTTACCAACA GGAGGCTCAT
    TTGGCGACAG

801 TGGCTCACCA ATGTTTATCT ATGATGCCCA AAAGCAAAAG
    TGGTTAATTA

851 ATGGGGTATT GCAAACAGGC AACCCCTATA TAGGAAAAAG
    CAATGGCTTC

901 CAGCTAGTTC GTAAAGATTG GTTCTATGAT GAAATCTTTG
    CTGGAGATAC

951 CCATTCAGTA TTCTACGAAC CACATCAAAA TGGGAAATAC
    TTTTTTAACG

1001 ACAATAATAA TGGCGCAGGA AAAATCGATG CCAAACATAA
     ACACTATTCT
```

-continued

1051 CTACCTTATA GATTAAAAAC ACGAACCGTT CAATTGTTTA
     ATGTTTCTTT

1101 ATCCGAGACA GCAAGAGAAC CTGTTTATCA TGCTGCAGGT
     GGGGTCAACA

1151 GTTATCGACC CAGACTGAAT AATGGAGAAA ATATTTCCTT
     TATTGACAAA

1201 GGAAAAGGTG AATTGATACT TACCAGCAAC ATCAACCAAG
     GCGCGGGCGG

1251 TTTGTATTTT GAGGGTAATT TTACGGTCTC GCCTAAAAAC
     AACGAAACGT

1301 GGCAAGGCGC GGGCGTTCAT ATCAGTGATG GCAGTACCGT
     TACTTGGAAA

1351 GTAAACGGCG TGGCAAACGA CCGCCTGTCC AAAATCGGCA
     AAGGCACGCT

1401 GCTGGTTCAA GCCAAGGGG AAAACCAAGG CTCGGTCAGC
     GTGGGCGACG

1451 GTAAAGTCAT CTTAGATCAG CAGGCGGACG ATCAAGGCAA
     AAAACAAGCC

1501 TTTAGTGAAA TCGGCTTGGT CAGCGGCAGG GGGACGGTGC
     AACTGAATGC

1551 CGATAATCAG TTCAACCCCG ACAAACTCTA TTTCGGCTTT
     CGCGGCGGAC

1601 GTTTGGATTT GAACGGGCAT TCGCTTTCGT TCCACCGCAT
     TCAAAATACC

1651 GATGAAGGGG CGATGATTGT CAACCACAAT CAAGACAAAG
     AATCCACCGT

1701 TACCATTACA GGCAATAAAG ATATTACTAC AACCGGCAAT
     AACAACAACT

1751 TGGATAGCAA AAAAGAAATT GCCTACAACG GTTGGTTTGG
     CGAGAAAGAT

1801 GCAACCAAAA CGAACGGGCG GCTCAATCTG AATTACCAAC
     CGGAAGAAGC

1851 GGATCGCACT TTACTGCTTT CCGGCGGAAC AAATTTAAAC
     GGCAATATCA

1901 CGCAAACAAA CGGCAAACTG TTTTTCAGCG GCAGACCGAC
     ACCGCACGCC

1951 TACAATCATT TAGGAAGCGG GTGGTCAAAA ATGGAAGGTA
     TCCCACAAGG

2001 AGAAATCGTG TGGGACAACG ATTGGATCGA CCGCACATTT
     AAAGCGCAAA

2051 ACTTCCATAT TCAGGGCGGA CAAGCGGTGG TTTCCCGCAA
     TGTTGCCAAA

2101 GTGGAAGGCG ATTGGCATTT AAGCAATCAC GCCCAAGCAG
     TTTTCGCTGT

2151 CGCACCGCAT CAAAGCCACA CAATCTGTAC ACGTTCGGAC
     TGGACGGGTC

2201 TGACAAGTTG TACCGAAAAA ACCATTACCG ACGATAAAGT
     GATTGCTTCA

2251 TTGAGCAAGA CCGACATCAG AGGCAATGTC AGCCTTGCCG
     ATCACGCTCA

2301 TTTAAATCTC ACAGGACTTG CCACACTCAA CGGCAATCTT
     AGTGCAGGCG

2351 GAGACACGCA CTATACGGTT ACGCGCAACG CCACCCAAAA
     CGGCAACCTC

2401 AGCCTCGTGG GCAATGCCCA AGCAACATTT AATCAAGCCA
     CATTAAACGG

2451 CAACACATCG GCTTCGGACA ATGCTTCATT TAATCTAAGC
     AACAACGCCG

2501 TACAAAACGG CAGTCTGACG CTTTCCGACA ACGCTAAGGC
     AAACGTAAGC

2551 CATTCCGCAC TCAACGGCAA TGTCTCCCTA GCCGATAAGG
     CAGTATTCCA

2601 TTTTGAAAAC AGCCGCTTTA CCGGAAAAAT CAGCGGCGGC
     AAGGATACGG

2651 CATTACACTT AAAAGACAGC GAATGGACGC TGCCGTCGGG
     CACGGAATTA

2701 GGCAATTTAA ACCTTGACAA CGCCACCATT ACACTCAATT
     CCGCCTATCG

2751 ACACGATGCG GCAGGCGCGC AAACCGGCAG TGCGGCAGAT
     GCGCCGCGCC

2801 GCCGTTCGCG CCGTTCCCTA TTATCCGTTA CGCCGCCAAC
     TTCGGCAGAA

2851 TCCCGTTTCA ACACGCTGAC GGTAAACGGC AAATTGAACG
     GTCAGGGAAC

2901 ATTCCGCTTT ATGTCGGAAC TCTTCGGCTA CCGCAGCGGC
     AAATTGAAGC

2951 TGGCGGAAAG TTCCGAAGGC ACTTACACCT TGGCTGTCAA
     CAATACCGGC

3001 AACGAACCCG TAAGTCTCGA GCAATTGACG GTAGTGGAAG
     GAAAAGACAA

3051 CACACCGCTG TCCGAAAATC TTAATTTCAC CCTGCaaaAc
     gaacacgtcg 3101 atgccggcgc atggCGTTAT CAGCTTATCC gcaaagacgG
     CGAGTTCCgc 3151 CTGCATAATC CGGTCAAAGA CAAGAGCTT TCCGACAAAC
     TCGGCAAGgc 3201 gggagaaACA GAggccgccT TGACGGCAAA ACAGGCacaA
     CTTGCCGCCA 3251 AAcaacaggc ggaaaAAGAC AACgcgcaaa gccttgAcgc
     gctgattgcg 3301 gCcgggcgca atgccaccga AAAGGCAgaa agtgttgccg
     aaccgGCCCG 3351 GCAGGCAGGC GGGGAAAAtg ccgGCATTAT GCAGGCGGAG
     GAAGAGAAAA

3401 AACGGGTGCA GGCGGATAAA GACACCGCCT TGGCGAAACA
     GCGCGAAGCG

3451 GAAACCCGGC CGGCTACCAC CGCCTTCCCC CGCGCCCGCC
     GCGCCCGCCG

3501 GGATTTGCCG CAACCGCAGC CCCAACCGCA ACCCCAACCG
     CAGCGCGACC

3551 TGATCAGCCG TTATGCCAAT AGCGGTTTGA GTGAATTTTC
     CGCCACGCTC

3601 AACAGCGTTT TCGCCGTACA GGACGAATTG GACCGCGTGT
     TTGCCGAAGA

-continued

```
3651 CCGCCGCAAC GCCGTTTGGA CAAGCGGCAT CCGGGACACC
     AAACACTACC
3701 GTTCGCAAGA TTTCCGCGCC TACCGCCAAC AAACCGACCT
     GCGCCAAATC
3751 GGTATGCAGA AAAACCTCGG CAGCGGGCGC GTCGGCATCC
     TGTTTTCGCA
3801 CAACCGGACC GGAAACACCT TCGACGACGG CATCGGCAAC
     TCGGCACGGC
3851 TTGCCCACGG TGCCGTTTTC GGGCAATACG GCATCGGCAG
     GTTCGACATC
3901 GGCATCAGCG CGGGCGCGGG TTTTAGTAGC GGCAGCCTTT
     CAGACGGCAT
3951 CAGAGGCAAA ATCCGCCGCC GCGTGCTGCA TTACGGCATT
     CAGGCAACAT
4001 ACCGCGCAGG TTTCGGCGGA TTCGGCATCG AACCGCACAT
     CGGCGCAACG
```

-continued

```
4051 CGCTATTTCG TCCAAAAAGC GGATTACCGA TACGAAAACG
     TCAATATCGC
4101 CACCCCGGGC CTTGCATTCA ACCGCTACCG CGCGGGCATT
     AAGGCAGATT
4151 ATTCATTCAA ACCGGCGCAA CACATTTCCA TCACGCCTTA
     TTTGAGCCTG
4201 TCCTATACCG ATGCCGCTTC CGGCAAAGTC CGAACGCGCG
     TCAATACCGC
4251 CGTATTGGCG CAGGATTTCG GCAAAACCCG CAGTGCGGAA
     TGGGGCGTAA
4301 ACGCCGAAAT CAAAGGTTTC ACGCTGTCCC TCCACGCTGC
     CGCCGCCAAG
4351 GGGCCGCAAT TGGAAGCGCA GCACAGCGCG GGCATCAAAT
     TAGGCTACCG
4401 CTGGTAA
```

This is predicted to encode a protein having amino acid sequence <SEQ ID 654>:

```
   1 MKTTDKRTTE THRKAPKTGR IRFSPAYLAI CLSFGILPQA RAGHTYFGIN
  51 YQYYRDFAEN KGKFAVGAKD IEVYNKKGEL VGKSMTKAPM IDFSVVSRNG
 101 VAALAGDQYI SVAHNGGYN NVDFGAEGSN PDQHRFSYQI VKRNNYKAGT
 151 NGHPYGGDYH MPRLHKFVTD AEPVEMTSYM DGWKYADLNK YPDRVRIGAG
 201 RQYWRSDEDE PNNRESSYHI ASAYSWLVGG NTFAQNGSGG GTVNLGSEKI
 251 KHSPYGFLPT GGSFGDSGSP MFIYDAQKQK WLINGVLQTG NPYIGKSNGF
 301 QLVRKDWFYD EIFAGDTHSV FYEPHQNGKY FFNDNNNGAG KIDAKHKHYS
 351 LPYRLKTRTV QLFNVSLSET AREPVYHAAG GVNSYRPRLN NGENISFIDK
 401 GKGELILTSN INQGAGGLYF EGNFTVSPKN NETWQGAGVH ISDGSTVTWK
 451 VNGVANDRLS KIGKGTLLVQ AKGENQGSVS VGDGKVILDQ QADDQGKKQA
 501 FSEIGLVSGR GTVQLNADNQ FNPDKLYFGF RGGRLDLNGH SLSFHRIQNT
 551 DEGAMIVNHN QDKESTVTIT GNKDITTTGN NNNLDSKKEI AYNGWFGEKD
 601 ATKTNGGLNL NYPPEEADRT LLLSGGTNLN GNITQTNGKL FFSGRPTPHA
 651 YNHLGSGWSK MEGIPQGEIV WDNDWIDRTF KAENFHIQGG QAVVSRNVAK
 701 VEGDWHLSNH AQAVFGVAPH QSHTICTRSD WTGLTSCTEK TITDDKVIAS
 751 LSKTDVRGNV SLADHAHLNL TGLATFNGNL VQAETRTIRL RANATQNGNL
 801 SLVGNAQATF NQATLNGNTS ASDNASFNLS NNAVQNGSLT LSDNAKANVS
 851 HSALNGNVSL ADKAVFHFEN SRFTGKISGG KDTALHLKDS EWTLPSGTEL
 901 GNLNLDNATI TLNSAYRHDA AGAQTGSAAD APRRRSRRSL LSVTPPTSAE
 951 SRFNTLTVNG KLNGQGTFRF MSELFGYRSG KLKLAESSEG TYTLAVNNTG
1001 NEPVSLEQLT VVEGKDNTPL SENLNFTLQN EHVDAGAWRY QLIRKDGEFR
1051 LHNPVKEQEL SDKLGKAGET EAALTAKQAQ LAAKQQAEKD NAQSLDALIA
1101 AGRNATEKAE SVAEPARQAG GENAGIMQAE EEKKRVQADK DTALAKQREA
1151 ETRPATTAFP RARRARRDLP QPQPQPQPQP QRDLISRYAN SGLSEFSATL
1201 NSVFAVQDEL DRVFAEDRRN AVWTSGIRDT KHYRSQDFRA YRQQTDLRQI
```

```
                        -continued
1251 GMQKNLGSGR VGILFSHNRT GNTFDDGIGN SARLAHGAVF GQYGIGRFDI

1301 GISAGAGFSS GSLSDGIRGK IRRRVLHYGI QARYRAGFGG FGIEPHIGAT

1351 RYFVQKADYR YENVNIATPG LAFNRYRAGI KADYSFKPAQ HISITPYLSL

1401 SYTDAASGKV RTRVNTAVLA QDFGKTRSAE WGVNAEIKGF TLSLHAAAAK

1451 GPQLEAQHSA GIKLGYRW*
```

Underlined and double-underlined sequences represent the active site of a serine protease (trypsin family) and an ATP/GTP-binding site motif A (P-loop).

```
ORF1-1 and ORF1ng show 93.7% identity in 1471 aa overlap:

10         20         30         40         50         60
       orf1-1.pep  MKTTDKRTTETHRKAPKTGRIRFSPAYLAICLSFGILPQAWAGHTYFGINYQYYRDFAEN
                   ||||||||||||||||||||||||||||||||||||| ||||||||||||||||||||||
       orf1ng-1    MKTTDKRTTETHRKAPKTGRIRFSPAYLAICLSFGILPQARAGHTYFGINYQYYRDFAEN
                      10         20         30         40         50         60

70         80         90        100        110        120
       orf1-1.pep  KGKFAVGAKDIEVYNKKGELVGKSMTKAPMIDFSVVSRNGVAALVGDQYIVSVAHNGGYN
                   |||||||||||||||||||||||||||||||||||||||||:||||||||||||||||||
       orf1ng-1    KGKFAVGAKDIEVYNKKGELVGKSMTKAPMIDFSVVSRNGVAAAVGDQYIVSVAHNGGYN
                      70         80         90        100        110        120

130        140        150        160        170        180
       orf1-1.pep  NVDFGAEGRNPDQHRFTYKIVKRNNYKAGTKGHPYGGDYHMPRLHKFVTDAEPVEMTSYM
                   ||||||||:||||||||:|:|||||||||||:||||||||||||||||||||||V||||
       orf1ng-1    NVDFGAEGSNPDQHRFSYQIVKRNNYKAGTNGHPYGGDYHMPRLHKFVTDAEPVEMTSYM
                     130        140        150        160        170        180

190        200        210        220        230        240
       orf1-1.pep  DGRKYIDQNNYPDRVRIGAGRQYWRSDEDEPNNRESSYHIASAYSWLVGGNTFAQNGSGG
                   || ||  |:||||||||||||||||||||||||||||||||||||||||||||||||||
       orf1ng-1    DGWKYADLNKYPDRVRIGAGRQYWRSDEDEPNNRESSYHIASAYSWLVGGNTFAQNGSGG
                     190        200        210        220        230        240

250        260        270        280        290        300
       orf1-1.pep  GTVNLGSEKIKHSPYGFLPTGGSFGDSGSPMFIYDAQKQKWLINGVLQTGNPYIGKSNGF
                   ||||||||||||||||||||||||||||||||||||||||||||||||||||||||||||
       orf1ng-1    GTVNLGSEKIKHSPYGFLPTGGSFGDSGSPMFIYDAQKQKWLINGVLQTGNPYIGKSNGF
                     250        260        270        280        290        300

310        320        330        340        350        360
       orf1-1.pep  QLVRKDWFYDEIFAGDTHSVFYEPRQNGKYSFNDDNNGTGKINAKHEHNSLPNRLKTRTV
                   ||||||||||||||||||||||||||:|||| |||:|||:|||:|||:| |||||||||
       orf1ng-1    QLVRKDWFYDEIFAGDTHSVFYEPHQNGKYFFNDNNNGAGKIDAKHKHYSLPYRLKTRTV
                     310        320        330        340        350        360

370        380        390        400        410        420
       orf1-1.pep  QLFNVSLSETAREPVYHAAGGVNSYRPRLNNGENISFIDEGKGELILTSNINQGAGGLYF
                   ||||||||||||||||||||||||||||||||||||||:|||||||||||||||||||||
       orf1ng-1    QLFNVSLSETAREPVYHAAGGVNSYRPRLNNGENISFIDKGKGELILTSNINQGAGGLYF
                     370        380        390        400        410        420

430        440        450        460        470        480
       orf1-1.pep  QGDFTVSPENNETWQGAGVHISEDSTVTWKVNGVANDRLSKIGKGTLHVQAKGENQGSIS
                   :|:||||||:|||||||||||||:|||||||||||||||||||||||:|||||||||:|
       orf1ng-1    EGNFTVSPKNNETWQGAGVHISDGSTVTWKVNGVANDRLSKIGKGTLLVQAKGENQGSVS
                     430        440        450        460        470        480

490        500        510        520        530        540
       orf1-1.pep  VGDGTVILDQQADDKGKKQAFSEIGLVSGRGTVQLNADNQFNPDKLYFGFRGGRLDLNGH
                   ||||:||||||||||:||||||||||||||||||||||||||||||||||||||||||||
       orf1ng-1    VGDGKVILDQQADDQGKKQAFSEIGLVSGRGTVQLNADNQFNPDKLYFGFRGGRLDLNGH
                     490        500        510        520        530        540

500        560        570        580        590        600
       orf1-1.pep  SLSFHRIQNTDEGAMIVNHNQDKESTVTITGNKDIATTGNNNSLDSKKEIAYNGWFGEKD
                   |||||||||||||||||||||||||||||||||||:|||||:||||||||||||||||||
       orf1ng-1    SLSFHRIQNTDEGAMIVNHNQDKESTVTITGNKDITTTGNNNNLDSKKEIAYNGWFGEKD
                     550        560        570        580        590        600

610        620        630        640        650        660
       orf1-1.pep  TTKTNGRLNLVYQPAAEDRTLLLSGGTNLNGNITQTNGKLFFSGRPTPHAYNHLNDHWSQ
                   :|||||||||| |||||:||||||||||||||||||||||||||||||||||||::||:
       orf1ng-1    ATKTNGRLNLNYQPEEADRTLLLSGGTNLNGNITQTNGKLFFSGRPTPHAYNHLGSGWSK
                     610        620        630        640        650        660

670        680        690        700        710        720
       orf1-1.pep  KEGIPRGEIVWDNDWINRTFKAENFQIKGGQAVVSRNVAKVKGDWHLSNHAQAVFGVAPH
                   |||:|:|||||||||:|||||||||:||||||||||||||:||||||||||||||||||
       orf1ng-1    MEGIPQGEIVWDNDWIDRTFKAENFHIQGGQAVVSRNVAKVEGDWHLSNHAQAVFGVAPH
                     670        680        690        700        710        720
```

```
                  730       740       750       760       770       780
orf1-1.pep  QSHTICTRSDWTGLTNCVEKTITDDKVIASLTKTDISGNVDLADHAHLNLTGLATLNGNL
            ||||||||||||||:|||||||||||||||:||||:|||:||||||||||||||||||||
orf1ng-1    QSGTICTRSDWTGLTSCTEKTITDDKVIASLSKTDIRGNVSLADHAHLNLTGLATLNGNL
                  730       740       750       760       770       780

790       800       810       820       830       840
orf1-1.pep  SANGDTRYTVSHNATQNGNLSLVGNAQATFNQATLNGNTSASGNASFNLSDHAVQNGSLT
            ||:||||:||:::||||||||||||||||||||||||||||:|||||||:|:||||||||
orf1ng-1    SAGGDTHYTVTRNATQNGNLSLVGNAQATFNQATLNGNTSASDNASFNLSNNAVQNGSLT
                  790       800       810       820       830       840

850       860       870       880       890       900
orf1-1.pep  LSGNAKANVSHSALNGNVSLADKAVFHFESSRFTGQISGGKDTALHLKDSEWTLPSGTEL
            ||:|||||||||||||||||||||||||:||||:||||||||||||||||||||||||||
orf1ng-1    LSDNAKANVSHSALNGNVSLADKAVFHFENSRFTGKISGGKDTALHLKDSEWTLPSGTEL
                  850       860       870       880       890       900

910       920       930       940       950       960
orf1-1.pep  GNLNLDNATITLNSAYRHDAAGAQTGSATDAPRRRSRRSRRSLLSVTPPTSVESRFNTLT
            |||||||||||||||||||||||||||:||||||||   ||||||||||||:||||||||
orf1ng-1    GNLNLDNATITLNSAYRHDAAGAQTGSAADAPRRRSR---RSLLSVTPPTSAESRFNTLT
                  910       920       930          940       950

970       980       990      1000      1010      1020
orf1-1.pep  VNGKLNGQGTFRFMSELFGYRSDKLKLAESSEGTYTLAVNNTGNEPASLEQLTVVEGKDN
            ||||||||||||||||||||||:|||||||||||||||||||||||:|||||||||||||
orf1ng-1    VNGKLNGQGTFRFMSELFGYRSGKLKLAESSEGTYTLAVNNTGNEPVSLEQLTVVEGKDN
                  960       970       980       990      1000      1010

1030      1040      1050      1060      1070
orf1-1.pep  KPLSENLNFTLQNEHVDAGAWRYQLIRKDGEFRLHNPVKEQELSDKLGKA----------
            :||||||||||||||||||||||||||||||||||||||||||||||||||
orf1ng-1    TPLSENLNFTLQNEHVDAGAWRYQLIRKDGEFRLHNPVKEQELSDKLGKAGETEAALTAK
                 1020      1030      1040      1050      1060      1070

1080      1090      1100      1110      1120
orf1-1.pep  ----EAKKQAEKDNAQSLDALIAAGRDAVEKTESVAEPARQAGGENVGIMQAEEEKKRVQ
                ||:|||||||||||||||||||||:|:|||||||||||||||||:|||||||||||||
orf1ng-1    QAQLAAKQQAEKDNAQSLDALIAAGRNATEKAESVAEPARQAGGENAGIMQAEEEKKRVQ
                 1080      1090      1100      1110      1120      1130

1130      1140      1150      1160      1170      1180
orf1-1.pep  ADKDTALAKQREAETRPATTAFPRARRARRDLPQLQPQPQPQPQRDLISRYANSGLSEFS
            ||||||||||||||||||||||||||||||||:|||||||||||||||||||||||||||
orf1ng-1    ADKDTALAKQREAETRPATTAFPRARRARRDLPQPQPQPQPQPQRDLISRYANSGLSEFS
                 1140      1150      1160      1170      1180      1190

1190      1200      1210      1220      1230      1240
orf1-1.pep  ATLNSVFAVQDELDRVFAEDRRNAVWTSGIRDTKHYRSQDFRAYRQQTDLRQIGMQKNLG
            ||||||||||||||||||||||||||||||||||||||||||||||||||||||||||||
orf1ng-1    ATLNSVFAVQDELDRVFAEDRRNAVWTSGIRDTKHYRSQDFRAYRQQTDLRQIGMQKNLG
                 1200      1210      1220      1230      1240      1250

1250      1260      1270      1280      1290      1300
orf1-1.pep  SGRVGILFSHNRTENTFDDGIGNSARLAHGAVFGQYGIDRFYIGISAGAGFSSGSLSDGI
            |||||||||||||||:||||||||||||||||||||||||:||||||||||||||||||
orf1ng-1    SGRVGILFSHNRTGNTFDDGIGNSARLAHGAVFGQYGIGRFDIGISAGAGFSSGSLSDGI
                 1260      1270      1280      1290      1300      1310

1310      1320      1330      1340      1350      1360
orf1-1.pep  GGKIRRRVLHYGIQARYRAGFGGFGIEPHIGATRYFVQKADYRYENVNIATPGLAFNRYR
            :|||||||||||||||||||||||||||||||||||||||||||||||||||||||||||
orf1ng-1    RGKIRRRVLHYGIQARYRAGFGGFGIEPHIGATRYFVQKADYRYENVNIATPGLAFNRYR
                 1320      1330      1340      1350      1360      1370

1370      1380      1390      1400      1410      1420
orf1-1.pep  AGIKADYSFKPAQHISITPYLSLSYTDAASGKVRTRVNTAVLAQDFGKTRSAEWGVNAEI
            ||||||||||||||||||||||||||||||||||||||||||||||||||||||||||||
orf1ng-1    AGIKADYSFKPAQHISITPYLSLSYTDAASGKVRTRVNTAVLAQDFGKTRSAEWGVNAEI
                 1380      1390      1400      1410      1420      1430

1430      1440      1450
orf1-1.pep  KGFTLSLHAAAAKGPQLEAQHSAGIKLGYRWX
            |||||||||||||||||||||||||||||||
orf1ng-1    KGFTLSLHAAAAKGPQLEAQHSAGIKLGYRWX
                 1440      1450      1460
```

In addition, ORF1ng shows 55.7% identity with hap protein (P45387) over a 1455aa overlap:

SCORES Initl: 1104 Initn: 4632 Opt: 2680
Smith-Waterman score: 5165; 55.7% identity in 1455 aa overlap

```
                     10        20        30        40        50        60
orf1ng-1.pep  MKTTDKRTTETHRKAPKTGRIRFSPAYLAICLSFGILPQARAGHTYFGINYQYYRDFAEN
                          |  :|:  |:|:||:  ||  ||||||||||:|||||||||
p45387              MKKTVFRLNFLTACISLGIVSQAWAGHTYFGIDYQYYRDFAEN
                            10        20        30        40
```

```
              70         80         90        100        110        120
orf1ng-1.pep KGKFAVGAKDIEVYNKKGELVGKSMTKAPMIDFSVVSRNGVAALAGDQYIVSVAHNGGYN
             ||| |:|||::|||||:|:|||  |||||||||||||||||||:  :|||||||| ||:
p45387       KGKFTVGAQNIKVYNKQGQLVGTSMTKAPMIDFSVVSRNGVAALVENQYIVSAHNVGYT
              50         60         70         80         90        100

130        140        150        160        170        180
orf1ng-1.pep NVDFGAEGSNPDQHRFSYQIVKRNNYKAGTNGHPYGGDYHMPRLHKFVTDAEPVEMTSYM
             :|||||||:|||||||| |:||||||||   |||  |||:|||||||||:|  :||| |
p45387       DVDFGAEGNNPDQHRFTYKIVKRNNYKKD-NLHPYEDDYHNPRLHKFVTEAAPIDMTSNM
             110        120        130        140        150        160

190        200        210        220        230        240
orf1ng-1.pep DGWKYADLNKYPDRVRIGAGRQYWRSDEDEPNNRESSYHIASAYSWLVGGNTFAQNGSGG
             :|   |:  |:|||||| ||||:||:|: :     |:  |:  |: :||||  |:|:|
p45387       NGSTYSDRTKYPERVRIGSGRQFWRNDQDKGD------QVAGAYHYLTAGNTHNQRGAGN
             170        180        190          200        210

250        260        270        280        290        300
orf1ng-1.pep GTVNLGSEKIKHSPYGFLPTGGSFGDSGSPMFIYDAQKQKWLINGVLQTGNPYIGKSNGF
             |    ||:: : |||| |  :|  |||||||||||:|||||||| | :|||  || ||
p45387       GYSYLGGDVRKAGEYGPLPIAGSKGDSGSPMFIYDAEKQKWLINGILREGNPFEGKENGF
             220        230        240        250        260        270

310        320        330        340        350        360
orf1ng-1.pep QLVRKDWFYDEIFAGDTHSVFYEPHQNGKYFFNDNNNGAGKIDAKHKHYSLPRLKTRTV
             |||||  :|  ||| :||| ||:|   ||   | :: |:  |:|  :   ::|  ::  :
p45387       QLVRKSYF-DEIFERDLHTSLYTRAGNGVYTISGNDNGQGSITQKS---GIPSEIK---I
             280        290        300        310        320

370        380        390        400        410       419
orf1ng-1.pep QLFNVSLSETAREPVYHAA-GGVNSYRPRLNNGENISFIDKGKGELILTSNINQGAGGLY
             | |:||  ::  :: ::     ||   ||||||:: :|: :| ||::|:|:||||||||
p45387       TLANMSLPLKEKDKVHNPRYDGPNIYSPRLNNGETLYFMDKQGSLIFASDINQGAGGLY
             330        340        350        360        370        380

420        430        440        450        460       479
orf1ng-1.pep FEGNFTVSPKNNETWQGAGVHISDGSTVTWKVNGVANDRLSKIGKGTLLVQAKGENQGSV
             |||||||||:||:||||||:|:|:|||||||||||| |||||||||||:||||||:|:|
p45387       FEGNFTVSPNSNQTWQGAGIHVSENSTVTWKVNGVEHDRLSKIGKGTLHVQAKGENKGSI
             390        400        410        420        430        440

480        490        500        510        520       539
orf1ng-1.pep SVGDGKVILDQQADDQGKKQAFSEIGLVSGRGTVQLNADNQFNPDKLYFGFRGGRLDLNG
             ||||||||| ||||||||:|||||||||||||||||| |:| | ||||||||||||||
p45387       SVGDGKVILEQQADDQGNKQAFSEIGLVSGRGTVQLNDDKQFDTDKFYFGFRGGRLDLNG
             450        460        470        480        490        500

540        550        560        570        580        590
orf1ng-1.pep HSLSFHRIQNTDEGAMIVNHNQDKESTVTITGNKDITT-TGNN-NNLDSKKEIAYNGWFG
             |||:|:|||||||||||||||::  ::|||||||:  ::  |:|:  ||||||||||||
p45387       HSLTFKRIQNTDEGAMIVNHNTTQAANVTITGNESIVLPNGNNINKLDYRKEIAYNGWFG
             510        520        530        540        550        560

600        610        620        630        640        650
orf1ng-1.pep EKDATKTNGRLNLNYQPEEADRTLLLSGGTNLNGNITQTNGKLFFSGRPTPHAYNHLGSG
             | |: | |||||||||:|||:|||||||||||| |||||| |||||||||||||| ||
p45387       ETDKNKHNGRLNLNLIYKPTTEDRTLLLSGGTNLKGDITQTKGKLFFSGRPTPHAYNHLNKR
             570        580        590        600        610        620

660        670        680        690        700        710
orf1ng-1.pep WSKMEGIPQGEIVWDNDWIDRTFKAENFHIQGGQAVVSRNVAKVEGDWHLSNHAQAVFGV
             ||: ||||||||||| |||:||||||||:|||| ||||||| :::|| : |:|:|:|||
p45387       WSEMEGIPQGEIVWDHDWINRTFKAENFQIKGGSAVVSRNVSSIEGNWTVSNNANATFGV
             630        640        650        660        670        680

720        730        740        750        760        770
orf1ng-1.pep APHQSHTICTRSDWTGLTSCTEKTITDDKVIASLSKTDIRGNVSLADHAHLNLTGLATLN
             :|:|:||||||||||||:||:||||:||||:| :||::|:|||:|||||:|| :|:|||
p45387       VPNQQNTICTRSDWTGLTTCQKVDLTDTKVINSIPKTQINGSINLTDNATANVKGLAKLN
             690        700        710        720        730        740

780        790        800        810        820        830
orf1ng-1.pep GNLSAGGDTHYTVTRNATQNGNLSLVGNAQATFNQATLNGNTSASDNASFNLSNNAVQNG
             ||:::                                  :::::|||||:||||||:|
p45387       GNVTL---------------------------------TNHSQFTLSNNATQIG
             750                                                760        770

840        850        860        870        880        890
orf1ng-1.pep SLTLSDNAKANVSHSALNGNVSLADKAVFHFENSRFTGKISGGKDTALHLKDSEWTLPSG
             ::|||||:|:|| ::|||||||:|:: ||||:|||| |:||||||:|| ||::||:|
p45387       NIRLSDNSTATVDNANLNGNVHLTDSAQFSLKNSHFSHQIQGDKGTTVTLENATWTMPSD
             780        790        800        810        820        830

900        910        920        930        940        950
orf1ng-1.pep TELGNLNLDNATITLNSAYRHDAAGAQTGSAADAPRRRSSRLLSVTPPTSAESRFNTLT
             |||:|:||| ||||||||        ::|: :: |||||   |:||||  ||:|||||
p45387       TTLQNLTLNNSTITLNSAY--------SASSNNTPRRRS---LETETTPTSAEHRFNTLT
             840        850        860        870

960        970        980        990       1000       1010
orf1ng-1.pep VNGKLNGQGTFRFMSELFGYRSGKLKLAESSEGTYTLAVNNTGNEPVSLEQLTVVEGKDN
             |||||:||||| |:| ||||:  |||| ::|  ||::|||||||  ||||| :|:|||
p45387       VNGKLSGQGTFQFTSSLFGYKSDKLKLSNDAEGDYILSVRNTGKEPETLEQLTLVESKDN
             880        890        900        910        920        930
```

-continued

```
                 1020       1030       1040       1050       1060       1070
orf1ng-1.pep  TPLSENLNFTLQNEGVDAGAWRYQLIRKDGEFRLHNPVKEQELSDKLGKAGETEAALTAK
              |||::|:|||:|:||||||  ||:|:::||||||||||:|||| :  |  :|  ::|  :| ||
p45387        QPLSDKLKFTLENDHVDAGALRYKLVKNDGEFRLHNPIKEQELHNDLVRAEQAERTLEAK
                 940        950        960        970        980        990

1080       1090       1100       1110       1120       1130
orf1ng-1.pep  QAQLAAKQQAEKDNAQSLDALIAAGRNAT-EKAESVAEPARQAGGENAGIMQAEEEKKRV
              |::|| ||: | ::   |   ||    ||  |     |  : |      |||:|| | |:|
p45387        QVEPTAKTQTGEPKVRSRRAARAAFPDTLPDQSLLNALEAKQAE-LTAETQKSKAKTKKV
                 1000       1010       1020       1030       1040       1050

1140       1150       1160       1170       1180       1190
orf1ng-1.pep  QADK---DTALAKQREAETRPATTAFPRARRARRD-LPQPQPQPQPQPQRDLISRYANSG
              ::  :  :  | |     :  |  ::   ::::|  |  ||: :  |  :|:|||||:||:
p45387        RSKRAVFSDPLLDQSLFALEAALEVIDAPQQSEKDRLAQEEAEKQ-RKQKDLISRYSNSA
                 1060       1070       1080       1090       1100       1110

1200       1210       1220       1230       1240       1250
orf1ng-1.pep  LSEFSATLNSVFAVQDELDRVFAEDRRNAVWTSGIRDTKHYRSQDPFRAYRQQ-TDLRQIG
              |||:|||:||:::||||||||:|:::    ::|||:   :|:|  ||||||| |:||||||
p45387        LSELSATVNSMLSVQDELDRLFVDQAQSAVWTNIAQDKRRYDSDAFRAYQQQKTNLRQIG
                 1120       1130       1140       1150       1160       1170

1260       1270       1280       1290       1300       1310
orf1ng-1.pep  MQKNLGSGRVGILFSHNRTGNTFDDGIGNSARLAHGAVFGQYGIGRFDIGISAGAGFSSG
              |||:||||:|:::|||||||||:|:::  :|||   :|  ::|| |:  ||||||:| ||
p45387        VQKALANGRIGAVFSHSRSDNTFDEQVKNHATLTMMSGFAQYQWGDLQFGVNVGTGISAS
                 1180       1190       1200       1210       1220       1230

1320       1330       1340       1350       1360       1370
orf1ng-1.pep  SLSDGIRGKIRRRVLHYGIQARYRAGFGGFGIEPHIGATRYFVQKADYRYENVNIATPGL
              ::::    ||:|::::||::|  |:     |||:|::|:|||:::   :|:  |:|  ||:|
p45387        KMAEEQSRKIHRKAINYGVNASYQFRLGQLGIQPYFGVNRYFIERENYQSEEVRVKTPSL
                 1240       1250       1260       1270       1280       1290

1380       1390       1400       1410       1420       1430
orf1ng-1.pep  AFNRYRAGIKADYSFKPAQHISITPYLSLSYTDAASGKVRTRVNTAVLAQDFGKTRSAEW
              |||||  |||:::||:|:   ||: |||:  ::|:|::::::::||  :|| :|| :| |
p45387        AFNRYNAGIRVDYTFTPTDNISVKPYFFVNYVDVSNANVQTTVNLTVLQQPFGRYWQKEV
                 1300       1310       1320       1330       1340       1350

1440       1450       1460       1469
orf1ng-1.pep  GVNAEIKGFTLSLHAAAAKGPQLEAQHSAGIKLGYRWX
              |::|||   | :|    : ::|  ||  |:::|||||||
p45387        GLKAEILHFQISAFISKSQGSQLGKQQNVGVKLGYRW
                 1360       1370       1380       1390
```

Based on this analysis, it is predicted that these proteins from *N. meningitidis* and *N. gonorrhoeae*, and their epitopes, could be useful antigens for vaccines or diagnostics, or for raising antibodies.

Example 78

The following partial DNA sequence was identified in *N. meningitidis* <SEQ ID 655>:

```
  1...AAGGTGTGGC AATTTGTCGA AGA.CCGCTG CGTGCCGTCG
       TGCCTGCCGA

51    CAGTTTTGAA CCGACCGCGC AAAAATTGAA CCTGTTTAAG
       GCGGGTGCGG

101    CAACCATTTT GTTTTATGAA GATCAAATG TCGTCAAAGG
       TTTGCAGGAG

151    CAGTTCCCTG CTTATGCCGC TAACTTCCCC GTTTGGGCGg
       ATCAGGCAAA

201    CGCGATGGTG CAGTATGCCG TTTGGACGAC ACTTGCCGCG
       GTCGGCGTAG

251    GTGCAAACCT GCAACATTAC AATCCCTTGC CCGATGCGGC
       GATTGCCAAA

301    GCGTGGAATA TCCCCGAAAA CTGGTTGTTG CGCGCACAAA
       TGGTTATCGG

351    CGGTATTGAA GGGGCGGCAG GTGAAAAGAC CTTTGAACCC
       GTTGCACAAC

401    GTTTGAAAGT GTTCGGCGCA TAA
```

This corresponds to the amino acid sequence <SEQ ID 656; ORF6>:

```
  1...KVWQFVEXPL RAVVPADSFE PTAQKLNLFK AGAATILFYE
       DQNVVKGLQE

51    QFPAYAANFP VWADQANAMV QYAVWTTLAA VGVGANLQHY
       NPLPDAAIAK

101    AWNIPENWLL RAQMVIGGIE GAAGEKTFEP VAERLKVFGA
       *
```

Further sequence analysis revealed a further partial DNA sequence <SEQ ID 657>:

```
  1...CTGCGTGCCG TCGTGCCTGC CGACAGTTTT GAACCGACCG
       CGCAAAAATT

51    GAACCTGTTT AAGGCGGGTG CGGCAACCAT TTTGTTTTAT
       GAAGATCAAA

101    ATGTCGTCAA AGGTTTGCAG GAGCAGTTCC CTGCTTATGC
       CGCTAACTTC

151    CCCGTTTGGG CGGATCAGGC AAACGCGATG GTGCAGTATG
       CCGTTTGGAC

201    GACACTTGCC GCGGTCGGCG TAGGTGCAAA CCTGCAACAT
       TACAATCCCT

251    TGCCCGATGC GGCGATTGCC AAAGCGTGGA ATATCCCCGA
       AAACTGGTTG

301    TTGCGCGCAC AAATGGTTAT CGGCGGTATT GAAGGGGCGG
       CAGGTGAAAA
```

-continued

```
351   GACCTTTGAA CCCGTTGCAG AACGTTTGAA AGTGTTCGGC
      GCATAA
```

This corresponds to the amino acid sequence <SEQ ID 658; ORF6-1>:

```
1 ...LRAVVPADSF EPTAQKLNLF KAGAATILFY EDQNVVKGLQ
     EQFPAYAANF
```

-continued

```
51    PVWADQANAM VQYAVWTTLA AVCVGANLQH YNPLPDAAIA
      KAWNIPENWL

101   LRAQMVIGGI EGAAGEKTFE PVAERLKVFG A*
```

Computer analysis of this amino acid sequence gave the following results:

Homology with a Predicted ORF from *N. meningitidis* (Strain A)

ORF6 shows 98.6% identity over a 140aa overlap with an ORF (ORF6a) from strain A of *N. meningitidis*.

```
                                                   10        20        30
orf6.pep                                 KVWQFVEXPLRAVVPADSFEPTAQKLNLFK
                                         |||||||  ||||||||||||||||||||
orf6a     QIVEHAVLHTPSSFNSQSARVVVLFGEEHDKVWQFVEDALRAVVPADSFEPTAQKLNLFK
                  40        50        60        70        80        90
                  40        50        60        70        80        90
orf6.pep  AGAATILFYEDQNVVKGLQEQFPAYAANFPVWADQANAMVQYAVWTTLAAVGVGANLQGY
          ||||||||||||||||||||||||||||||||||||||||||||||||||||||||||||
orf6a     AGAATILFYEDQNVVKGLQEQFPAYAANFPVWADQANAMVQYAVWTTLAAVGVGANLQGY
                 100       110       120       130       140       150
                 100       110       120       130       140
orf6.pep  NPLPDAAIAKAWNIPENWLLRAQMVIGGIEGAAGEKTFEPVAERLKVFGAX
          |||||||||||||||||||||||||||||||||||||||||||||||||||
orf6a     NPLPDAAIAKAWNIPENWLLRAQMVIGGIEGAAGEKTFEPVAERLKVFGAX
                 160       170       180       190       200
```

The complete length ORF6a nucleotide sequence <SEQ ID 659> is:

```
  1 ATGACCCGTC AATCTCTGCA ACAGGCTGCC GAAAGCCGCC GTTCCATTTA
 51 TTCGTTAAAT AAAAATCTGC CCGTCGGCAA AGATGAAATC GTCCAAATCG
101 TCGAACACGC CGTTTTGCAC ACACCTTCTT CGTTCAATTC CCAATCTGCC
151 CGTGTGGTCG TGCTGTTTGG CGAAGAGCAT GATAAGGTGT GGCAATTTGT
201 CGAAGACGCG CTGCGTGCCG TCGTGCCTGC CGACAGTTTT GAACCGACCG
251 CGCAAAAATT GAACCTGTTT AAGGCGGGTG CGGCAACTAT TTTGTTTTAT
301 GAAGATCAAA ATGTCGTCAA AGGTTTGCAG GAGCAGTTCC CTGCTTATGC
351 CGCCAACTTT CCCGTTTGGG CGGACCAGGC GAACGCGATG GTGCAGTATG
401 CCGTTTGGAC GACACTTGCC GCGGTCGGCG TAGGTGCAAA CCTGCAACAT
451 TACAATCCCT TGCCCGATGC GGCGATTGCC AAAGCGTGGA ATATCCCCGA
501 AAACTGGTTG TTGCGCGCAC AAATGGTTAT CGGCGGTATT GAAGGGGCGG
551 CAGGTGAAAA GACCTTTGAA CCAGTTGCAG AACGTTTGAA AGTGTTCGGC
601 GCATAA
```

This is predicted to encode a protein having amino acid sequence <SEQ ID 660>:

```
  1 MTRQSLQQAA ESRRSIYSLN KNLPVGKDEI VQIVEHAVLH TPSSFNSQSA
 51 RVVVLFGEEH DKVWQFVEDA LRAVVPADSF EPTAQKLNLF KAGAATILFY
101 EDQNVVKGLQ EQFPAYAANF PVWADQANAM VQYAVWTTLA AVGVGANLQH
151 YNPLPDAAIA KAWNIPENWL LRAQMVIGGI EGAAGEKTFE PVAERLKVFG
201 A*
```

ORF6a and ORF6-1 show 100.0% identity in 131 aa overlap:

```
                  50        60        70        80        90       100
orf6a.pep   TPSSFNSQSARVVVLFGEEHDKVWQFVEDALRAVVPADSFEPTAQKLNLFKAGAATILFY
                                        ||||||||||||||||||||||||||||||
orf6-1                                  LRAVVPADSFEPTAQKLNLFKAGAATILFY
                                                10        20        30

110       120       130       140       150       160
orf6a.pep   EDQNVVKGLQEQFPAYAANFPVWADQANAMVQYAVWTTLAAVGVGANLQHYNPLPDAAIA
            ||||||||||||||||||||||||||||||||||||||||||||||||||||||||||||
orf6-1      EDQNVVKGLQEQFPAYAANFPVWADQANAMVQYAVWTTLAAVGVGANLQHYNPLPDAAIA
                    40        50        60        70        80        90

170       180       190       200
orf6a.pep   KAWNIPENWLLRAQMVIGGIEGAAGEKTFEPVAERLKVFGAX
            |||||||||||||||||||||||||||||||||||||||||
orf6-1      KAWNIPENWLLRAQMVIGGIEGAAGEKTFEPVAERLKVFGAX
                   100       110       120       130
```

Homology with a Predicted ORF from *N. gonorrhoeae*

ORF6 shows 95.7% identity over a 140aa overlap with a predicted ORF (ORF6ng) from *N. gonorrhoeae*:

```
orf6.pep                          KVWQFVEXPLRAVVPADSFEPTAQKLNLFK    30
                                  |||||||| :|||||||||||||||||:|||
orf6ng      SNVSLDMSNPTVLRMGLPLYIASLRRGAIYKVWQFVEDALRAVVPADSFEPTAQKLKLFK    64 orf6.pep    AGAATILFYEDQNVVKGLQEQFPAYAANFPVWADQANAMVQYAVWTTLAAVGVGANLQHY    90
            |||||||||||||||||||||||||||||||||||||||||||||||||||: ||||||
orf6ng      AGAATILFYEDQNVVKGLQEQFPAYAANFPVWADQANAMVQYAVWTTLAAVGAGANLQHY   124 orf6.pep    NPLPDAAIAKAWNIPENWLLRAQMVIGGIEGAAGEKTFEPVAERLKVFGA             140
            ||||| :|||||||||||||||||||||||||||||: ||||||||||||
orf6ng      NPLPDVAIAKAWNIPENWLLRAQMVIGGIEGAAGEKVFEPVAERLKVFGA             174
```

The complete length ORF6ng nucleotide sequence <SEQ ID 661> was identified as:

```
  1 ATGGCCGTTG CGTCAAATGT CAGCTTGGAT ATGTCCAATC CTACGGTGTT
 51 ACGCATGGGA TTACCCTTAT ATATTGCGTC CCTAAGAAGG GGCGCAATAT
101 ATAAGGTGTG GCAATTTGTC GAAGACGCGC TGCGTGCCGT CGTGCCTGCC
151 GACAGTTTTG AACCGACCGC GCAAAAATTG AAGCTGTTTA AGGCGGGCGC
201 GGCAACCATT TTGTTTTATG AAGATCAAAA TGTCGTCAAA GGTTTGCAGG
251 AGCAGTTCCC TGCTTATGCC GCCAACTTTC CCGTTTGGGC GGACCAGGCG
301 AACGCTATGG TACAGTATGC CGTCTGGACG ACACTTGCCG CGGTCGGTGC
351 AGGTGCAAAT CTGCAACATT ACAACCCCTT GCCCGATGTG GCGATTGCTA
401 AAGCGTGGAA TATTCCCGAA AACTGGCTGT TGCGCGCGCA AATGGTTATC
451 GGTGGTATTG AAGGGGcggc aggtgaaaaa gtctttgaac CCGTTGCgga
501 acgtttgAAA GTGTTCGGCG CATAA
```

This encodes a protein having amino acid sequence <SEQ ID 662>:

```
  1 MAVASNVSLD MSNPTVLRMG LPLYIASLRR GAIYKVWQFV EDALRAVVPA
 51 DSFEPTAQKL KLFKAGAATI LFYEDQNVVK GLQEQFPAYA ANFPVWADQA
101 NAMVQYAVWT TLAAVGAGAN LQHYNPLPDV AIAKAWNIPE NWLLRAQMVI
151 GGIEGAAGEK VFEPVAERLK VFGA*
```

ORF6ng and ORF6-1 show 96.9% identity in 131 aa overlap:

```
                                              10        20        30
    orf6-1.pep                         LRAVVPADSFEPTAQKLNLFKAGAATILFY
                                       ||||||||||||||||:||||||||||||
    orf6ng      PTVLRMGLPLYIASLRRGAIYKVWQFVEDALRAVVPADSFEPTAQKLKLFKAGAATILFY
                        20        30        40        50        60        70

40        50        60        70        80        90
    orf6-1.pep  EDQNVVKGLQEQFPAYAANFPVWADQANAMVQYAVWTTLAAVGVGANLQHYNPLPDAAIA
                ||||||||||||||||||||||||||||||||||||||||||:|||||||||||:|||
    orf6ng      EDQNVVKGLQEQFPAYAANFPVWADQANAMVQYAVWTTLAAVGAGANLQHYNPLPDVAIA
                        80        90       100       110       120       130

100       110       120       130
    orf6-1.pep  KAWNIPENWLLRAQMVIGGIEGAAGEKTFEPVAERLKVFGAX
                |||||||||||||||||||||||||||:|||||||||||||
    orf6ng      KAWNIPENWLLRAQMVIGGIEGAAGEKVFEPVAERLKVFGAX
                        140       150       160       170
```

It is predicted that the proteins from *N. meningitidis* and *N. gonorrhoeae*, and their epitopes, could be useful antigens for vaccines or diagnostics, or for raising antibodies.

Example 79

The following partial DNA sequence was identified in *N. meningitidis* <SEQ ID 663>:

```
  1..GGCTACAACT ACCTGTTCGC GCGCGGCAGC CGCATCGCCA ACTACCAAAT
 51  CAACGGCATC CCCGTTGCCG ACGCGCTGGC CGATACGGGt CAATGCCAAC
101  ACCGCCGCCT ATGAGCGCGT AGAAGTCGTG CGCGGCGTGG CGGGGCTGCT
151  GGACGGCACG GGCGAGCCTT CCGCCACCGT CAATCTGGTG CGCAAACGCC
201  TGACCCGCAA GCCATTGTTT GAAGTCCGCG CCGAAGCgGG CAACCGcAAA
251  CATTTCGGGC TGGACGCGGA CGTATCGGGC AGCCTGAACA CCGAAG.crC
301  rCTGCGCgGC CGCCTGGTTT CCAcCTTCGG ACGCGGCGAC TCGTGGCGGC
351  GGCGCGAACG CAGCCGskAT GCCGAACTCT ACGGCATTTT GGAATACGAC
401  ATCGCACCGC AAACCCGCGT CCACGCArGC ATGGACTACC AGCAGGCGAA
451  AGAAACCGCC GACGCGCCGC TCAGcTACGC CGTGTACGAC AGCCAAGGTT
501  ATGCCACCGC CTTCGGCCCG AAAGACAACC CCGCCACAAA TTGGGCGAAC
551  AGCCACCACC GTGCGCTCAA CCTGTTCGCC GGCATCGAAC ACCGCTTCAA
601  CCAAGACTGG AAACTCAAAG CCGAATACGA CTAC..
```

This corresponds to the amino acid sequence <SEQ ID 664; ORF23>:

```
  1..GYNYLFARGS RIANYQINGI PVADALADTG NANTAAYERV EVVRGVAGLL
 51  DGTGEPSATV NLVRKRLTRK PLFEVRAEAG NRKHFGLDAD VSGSLNTEXX
101  LRGRLVSTFG RGDSWRRRER SRXAELYGIL EYDIAPQTRV HAXMDYQQAK
151  ETADAPLSYA VYDSQGYATA FGPKDNPATN WANSHHRALN LFAGIEHRFN
201  QDWKLKAEYD Y..
```

Further work revealed the complete nucleotide sequence
<SEQ ID 665>:

```
   1 ATGACACGCT TCAAATATTC CCTGCTGTTT GCCGCCCTGT TGCCCGTGTA
  51 CGCGCAGGCC GATGTTTCTG TTTCAGACGA CCCCAAACCG CAGGAAAGCA
 101 CTGAATTGCC GACCATCACC GTTACCGCCG ACCGCACCGC GAGTTCCAAC
 151 GACGGCTACA CTGTTTCCGG CACGCACACC CCGCTCGGGC TGCCCATGAC
 201 CCTGCGCGAA ATCCCGCAGA GCGTCAGCGT CATCACATCG CAACAAATGC
 251 GCGACCAAAA CATCAAAACG CTCGACCGCG CCCTGTTGCA GGCGACCGGC
 301 ACCAGCCGCC AGATTTACGG CTCCGACCGC GCGGGCTACA ACTACCTGTT
 351 CGCGCGCGGC AGCCGCATCG CCAACTACCA AATCAACGGC ATCCCCGTTG
 401 CCGACGCGCT GGCCGATACG GGCAATGCCA ACACCGCCGC CTATGAGCGC
 451 GTAGAAGTCG TGCGCGGCGT GGCGGGGCTG CTGGACGGCA CGGGCGAGCC
 501 TTCCGCCACC GTCAATCTGG TGCGCAAACG CCTGACCCGC AAGCCATTGT
 551 TTGAAGTCCG CGCCGAAGCG GGCAACCGCA AACATTTCGG GCTGGACGCG
 601 GACGTATCGG GCAGCCTGAA CACCGAAGGC ACGCTGCGCG GCCGCCTGGT
 651 TTCCACCTTC GGACGCGGCG ACTCGTGGCG CCGGCGCGAA CGCAGCCGCG
 701 ATGCCGAACT CTACGGCATT TGGAATACGA CATCGCACC GCAAACCCGC
 751 GTCCACGCAG GCATGGACTA CCAGCAGGCG AAAGAAACCG CCGACGCGCC
 801 GCTCAGCTAC GCCGTGTACG ACAGCCAAGG TTATGCCACC GCCTTCGGCC
 851 CGAAAGACAA CCCCGCCACA AATTGGGCGA ACAGCCGCCA CCGTGCGCTC
 901 AACCTGTTCG CCGGCATCGA ACACCGCTTC AACCAAGACT GGAAACTCAA
 951 AGCCGAATAC GACTACACCC GCAGCCGCTT CCGCCAGCCC TACGGCGTAG
1001 CAGGCGTGCT TTCCATCGAC CACAACACCG CCGCCACCGA CCTGATTCCC
1051 GGTTATTGGC ACGCCGACCC GCGCACCCAC AGCGCCAGCG TGTCATTGAT
1101 CGGCAAATAC CGCCTGTTCG GCCGCGAACA CGATTTAATC GCGGGTATCA
1151 ACGGTTACAA ATACGCCAGC AACAAATACG GCGAACGCAG CATCATCCCC
1201 AACGCCATTC CCAACGCCTA CGAATTTTCC CGCACGGGTG CCTACCCGCA
1251 GCCTGCATCG TTTGCCCAAA CCATCCCGCA ATACGGCACC AGGCGGCAAA
1301 TCGGCGGCTA TCTCGCCACC CGTTTCCGCG CCGCCGACAA CCTTTCGCTG
1351 ATTTTGGGCG GACGATACAC CCGTTACCGC ACCGGCAGCT ACGACAGCCG
1401 CACACAAGGC ATGACCTATG TGTCCGCCAA CCGTTTCACC CCCTACACAG
1451 GCATCGTGTT CGACCTGACC GGCAACCTGT CTCTTTACGG CTCGTACAGC
1501 AGCCTGTTCG TCCCGCAATC GCAAAAAGAC GAACACGGCA GCTACCTGAA
1551 ACCCGTAACC GGCAACAATC TGGAAGCCGG CATCAAAGGC GAATGGCTTG
1601 AAGGCCGTCT GAACGCATCC GCCGCCGTGT ACCGCGCCCG TAAAAACAAC
1651 CTCGCCACCG CAGCAGGACG CGACCCGAGC GGCAACACCT ACTACCGCGC
1701 CGCCAACCAA GCCAAAACCC ACGGCTGGGA AATCGAAGTC GGCGGCCGCA
1751 TCACGCCCGA ATGGCAGATA CAGGCAGGTT ACAGCCAAAG CAAACCCGC
1801 GACCAAGACG GCAGCCGCCT GAACCCCGAC AGCGTACCCG AACGCAGCTT
1851 CAAACTCTTC ACTGCCTACC ACTTTGCCCC CGAAGCCCCC AGCGGCTGGA
```

```
-continued
1901 CCATCGGCGC AGGCGTGCGC TGGCAGAGCG AAACCCACAC CGACCCTGCC

1951 ACGCTCCGCA TCCCCAACCC CGCCGCCAAA GCCCGCGCCG CCGACAACAG

2001 CCGCCAAAAA GCCTACGCCG TCGCCGACAT CATGGCGCGT TACCGCTTCA

2051 ATCCGCGCGC CGAACTGTCG CTGAACGTGG ACAATCTGTT CAACAAACAC

2101 TACCGCACCC AGCCCGACCG CCACAGCTAC GGCGCACTGC GGACAGTGAA

2151 CGCGGCGTTT ACCTATCGGT TTAAATAA
```

This corresponds to the amino acid sequence <SEQ ID 666; ORF23-1>:

```
  1 MTRFKYSLLF AALLPVYAQA DVSVSDDPKP QESTELPTIT VTADRTASSN

51 DGYTVSGTHT PLGLPMTLRE IPQSVSVITS QQMRDQNIKT LDRALLQATG

101 TSRQIYGSDR AGYNYLFARG SRIANYQING IPVADALADT GNANTAAYER

151 VEVVRGVAGL LDGTGEPSAT VNLVRKRLTR KPLFEVRAEA GNRKHFGLDA

201 DVSGSLNTEG TLRGRLVSTF GRGDSWRRRE RSRDAELYGI LEYDIAPQTR

251 VHAGMDYQQA KETADAPLSY AVYDSQGYAT AFGPKDNPAT NWANSRHRAL

301 NLFAGIEHRF NQDWKLKAEY DYTRSRFRQP YGVAGVLSID HNTAATDLIP

351 GYWHADPRTH SASVSLIGKY RLFGREHDLI AGINGYKYAS NKYGERSIIP

401 NAIPNAYEFS RTGAYPQPAS FAQTIPQYGT RRQIGGYLAT RFRAADNLSL

451 ILGGRYTRYR TGSYDSRTQG MTYVSANRFT PYTGIVFDLT GNLSLYGSYS

501 SLFVPQSQKD EHGSYLKPVT GNNLEAGIKG EWLEGRLNAS AAVYRARKNN

551 LATAAGRDPS GNTYYRAANQ AKTHGWEIEV GGRITPEWQI QAGYSQSKTR

601 DQDGSRLNPD SVPERSFKLF TAYHFAPEAP SGWTIGAGVR WQSETHTDPA

651 TLRIPNPAAK ARAADNSRQK AYAVADIMAR YRFNPRAELS LNVDNLFNKH

701 YRTQPDRHSY GALRTVNAAF TYRFK*
```

Computer analysis of this amino acid sequence gave the following results:

Homology with the Ferric-Pseudobactin Receptor PupB of *Pseudomonas putida* (Accession Number P38047)
ORF23 and PupB protein show 32% aa identity in 205aa overlap:

```
Orf23    6 FARGSRIANYQINGIPVADALADTGNANTAAYERVEVVRGVAGLLDGTGEPSATVNLVRK  65
           ++RG  I NY+++G+P +  L D  + + A ++RVE+VRG  GL+  G G PSAT+NL+RK
PupB   215 WSRGFAIQNYEVDGVPTSTRL-DNYSQSMAMFDRVEIVRGATGLISGMGNPSATINLIRK  273

Orf23   66 RLTRKPLFEVRAEAGNRKHFGLDADVSGSLNTEXXLRGRLVSTFXXXXXXXXXXXXXXAE  125
            R T +    +  EAGN  +G   DVSG L      +RGR V+  +
PupB   274 RPTAEAQASITGEAGNWDRYGTGFDVSGPLTETGNIRGRFVADYKTEKAWIDRYNQQSQL  333

Orf23  126 LYGILEYDIAPQTRVHAXMDYQQAKETADAPLSYAVYD--SQGYATAFGPKDNPATNWAN  183
           +YGI E+D++  T +    Y   +    D+PL +     S G T    N A +W+
PupB   334 MYGITEFDLSEDTLLTVGFSY--LRSDIDSPLRSGLPTRFSTGERTNLKRSLNAAPDWSY  391

Orf23  184 SHHRALNLFAGIEHRFNQDWKLKAE                                    208
           + H   + F  IE+     W K E
PupB   392 NDHEQTSFFTSIEQQLGNGWSGKIE                                    416
```

Homology with a Predicted ORF from *N. meningitidis* (Strain A)

ORF23 shows 95.7% identity over a 211aa overlap with an ORF (ORF23a) from strain A of *N. meningitidis*:

```
                                   10         20         30
orf23.pep                    GYNYLFARGSRIANYQINGIPVADALADTG
                             ||||||||||||||||||||||||||||||
orf23a       QMRDQNIKALDRALLQATGTSRQIYGSDRAGYNYLFARGSRIANYQINGIPVADALADTG
                 90        100       110       120       130       140
                   40         50         60         70         80         90
orf23.pep    NANTAAYERVEVVRGVAGLLDGTGEPSATVNLVRKRLTRKPLFEVRAEAGNRKHFGLDAD
             |||||||||||||||||||||||||||||||||||| |||||||||||||||||||| ||
orf23a       NANTAAYERVEVVRGVAGLLDGTGEPSATVNLVRKRPTRKPLFEVRAEAGNRKHFGLGAD
                 150       160       170       180       190       200
                  100       110       120       130       140       150
orf23.pep    VSGSLNTEXXLRGRLVSTFGRGDSWRRRERSRXAELYGILEYDIAPQTRVHAXMDYQQAK
             |||||| :| :|||||||||||||||| |||||:||||||||||||||||| |||||||
orf23a       VSGSLNAEGTLRGRLVSTFGRGDSWRQRERSRDAELYGILEYDIAPQTRVHAGMDYQQAK
                 210       220       230       240       250       260
                  160       170       180       190       200       210
orf23.pep    ETADAPLSYAVYDSQGYATAFGPKDNPATNWANSHHRALNLFAGIEHRFNQDWKLKAEYD
             |||||||||||||||||||||||||||||||||||:||||||||||||||||||||||||
orf23a       ETADAPLSYAVYDSQGYATAFGPKDNPATNWANSRHRALNLFAGIEHRFNQDWKLKAEYD
                 270       280       290       300       310       320
orf23.pep    Y
             |
orf23a       YTRSRFRQPYGVAGVLSIDHNTAATDLIPGYWHADPRTHSASVSLIGKYRLFGREHDLIA
                 330       340       350       360       370       380
```

The complete length ORF23a nucleotide sequence <SEQ ID 667> is:

```
   1 ATGACACGCT TCAAATATTC CCTGCTGTTT GCCGCCCTGT TGCCCGTGTA

51 CGCGCAGGCC GATGTTTCTG TTTCAGACGA CCCAAAACCG CAGGAAAGCA

101 CTGAATTGCC GACCATCACC GTTACCGCCG ACCGCACCGC GAGTTCCAAC

151 GACGGCTACA CTGTTTCCGG CACGCACACC CCGCTCGGGC TGCCCATGAC

201 CCTGCGCGAA ATCCCGCAGA GCGTCAGCGT CATCACATCG CAACAAATGC

251 GCGACCAAAA CATCAAAGCG CTCGACCGCG CCCTGTTGCA GGCGACCGGC

301 ACCAGCCGCC AGATTTACGG CTCCGACCGC GCGGGCTACA ACTACCTGTT

351 CGCGCGCGGC AGCCGCATCG CCAACTACCA AATCAACGGC ATCCCCGTTG

401 CCGACGCGCT GGCCGATACG GGCAATGCCA ACACCGCCGC CTATGAGCGC

451 GTAGAAGTCG TGCGCGGCGT GGCGGGGCTG CTGGACGGCA CGGGCGAGCC

501 TTCCGCCACC GTCAATCTGG TGCGCAAACG CCCGACCCGC AAGCCATTGT

551 TTGAAGTCCG CGCCGAAGCG GGCAACCGCA AACATTTCGG GCTGGGCGCG

601 GACGTATCGG GCAGCCTGAA TGCCGAAGGC ACGCTGCGCG GCCGCCTGGT

651 TTCCACCTTC GGACGCGGCG ACTCGTGGCG GCAGCGCGAA CGCAGCCGCG

701 ATGCCGAACT CTACGGCATT TTGGAATACG ACATCGCACC GCAAACCCGC

751 GTCCACGCAG GCATGGACTA CCAGCAGGCG AAAGAAACCG CCGACGCGCC

801 GCTCAGCTAC GCCGTGTACG ACAGCCAAGG TTATGCCACC GCCTTCGGCC

851 CGAAAGACAA CCCCGCCACA AATTGGGCGA ACAGCCGCCA CCGTGCGCTC

901 AACCTGTTCG CCGGCATCGA ACACCGCTTC AACCAAGACT GGAAACTCAA

951 AGCCGAATAC GACTACACCC GCAGCCGCTT CCGCCAGCCC TACGGCGTAG

1001 CAGGCGTGCT TTCCATCGAC CACAACACCG CCGCCACCGA CCTGATTCCC
```

-continued

```
1051 GGTTATTGGC ACGCCGACCC GCGCACCCAC AGCGCCAGCG TGTCATTAAT

1101 CGGCAAATAC CGCCTGTTCG GCCGCGAACA CGATTTAATC GCGGGTATCA

1151 ACGGTTACAA ATACGCCAGC AACAAATACG GCGAACGCAG CATCATCCCC

1201 AACGCCATTC CCAACGCCTA CGAATTTTCC CGCACGGGTG CCTACCCGCA

1251 GCCTGCATCG TTTGCCCAAA CCATCCCGCA ATACGGCACC AGGCGGCAAA

1301 TCGGCGGCTA TCTCGCCACC CGTTTCCGCG CCGCCGACAA CCTTTCGCTG

1351 ATACTCGGCG GCAGATACAG CCGTTACCGC ACCGGCAGCT ACGACAGCCG

1401 CACACAAGGC ATGACCTATG TGTCCGCCAA CCGTTTCACC CCCTACACAG

1451 GCATCGTGTT CGACCTGACC GGCAACCTGT CGCTTTACGG CTCGTACAGC

1501 AGCCTGTTCG TCCCGCAATC GCAAAAAGAC GAACACGGCA GCTACCTGAA

1551 ACCCGTAACC GGCAACAATC TGGAAGCCGG CATCAAAGGC GAATGGCTTG

1601 AAGGCCGTCT GAACGCATCC GCCGCCGTGT ACCGCGCCCG TAAAAACAAC

1651 CTCGCCACCG CAGCAGGACG CGACCCGAGC GGCAACACCT ACTACCGCGC

1701 CGCCAACCAA GCCAAAACCC ACGGCTGGGA AATCGAAGTC GGCGGCCGCA

1751 TCACGCCCGA ATGGCAGATA CAGGCAGGTT ACAGCCAAAG CAAAACCCGC

1801 GACCAAGACG GCAGCCGCCT GAACCCCGAC AGCGTACCCG AACGCAGCTT

1851 CAAACTCTTC ACTGCCTACC ACTTTGCCCC CGAAGCCCCC AGCGGCTGGA

1901 CCATCGGCGC ACGCGTGCGC TGGCAGAGCG AAACCCACAC CGACCCTGCC

1951 ACGCTCCGCA TCCCCAACCC CGCCGCCAAA GCCCGCGCCG CCGACAACAG

2001 CCGCCAAAAA GCCTACGCCG TCGCCGACAT CATGGCGCGT TACCGCTTCA

2051 ATCCGCGCGC CGAACTGTCG CTGAACGTGG ACAATCTGTT CAACAAACAC

2101 TACCGCACCC AGCCCGACCG CCACAGCTAC GGCGCACTGC GGACAGTGAA

2151 CGCGGCGTTT ACCTATCGGT TTAAATAA
```

This encodes a protein having amino acid sequence <SEQ ID 668>:

```
  1 MTRFKYSLLF AALLPVYAQA DVSVSDDPKP QESTELPTIT VTADRTASSN

51 DGYTVSGTHT PLGLPMTLRE IPQSVSVITS QQMRDQNIKA LDRALLQATG

101 TSRQIYGSDR AGYNYLFARG SRIANYQING IPVADALADT GNANTAAYER

151 VEVVRGVAGL LDGTGEPSAT VNLVRKRPTR KPLFEVRAEA GNRKHFGLGA

201 DVSGSLNAEG TLRGRLVSTF GRGDSWRQRE RSRDAELYGI LEYDIAPQTR

251 VHAGMDYQQA KETADAPLSY AVYDSQGYAT AFGPKDNPAT NWANSRHRAL

301 NLFAGIEHRF NQDWKLKAEY DYTRSRFRQP YGVAGVLSID HNTAATDLIP

351 GYWHADPRTH SASVSLIGKY RLFGREHDLI AGINGYKYAS NKYGERSIIP

401 NAIPNAYEFS RTGAYPQPAS FAQTIPQYGT RRQIGGYLAT RFRAADNLSL

451 ILGGRYSRYR TGSYDSRTQG MTYVSANRFT PYTGIVFDLT GNLSLYGSYS

501 SLFVPQSQKD EHGSYLKPVT GNNLEAGIKG EWLEGRLNAS AAVYRARKNN

551 LATAAGRDPS GNTYYRAANQ AKTHGWEIEV GGRITPEWQI QAGYSQSKTR

601 DQDGSRLNPD SVPERSFKLF TAYHFAPEAP SGWTIGAGVR WQSETHTDPA
```

```
651 TLRIPNPAAK ARAADNSRQK AYAVADIMAR YRFNPRAELS LNVDNLFNKH

701 YRTQPDRHSY GALRTVNAAF TYRFK*
```

ORF23a and ORF23-1 show 99.2% identity in 725 aa overlap:

```
                      10         20         30         40         50         60
orf23a.pep    MTRFKYSLLFAALLPVYAQADVSVSDDPKPQESTELPTITVTADRTASSNDGYTVSGTHT
              ||||||||||||||||||||||||||||||||||||||||||||||||||||||||||||
orf23-1       MTRFKYSLLFAALLPVYAQADVSVSDDPKPQESTELPTITVTADRTASSNDGYTVSGTHT
                      10         20         30         40         50         60

70         80         90        100        110        120
orf23a.pep    PLGLPMTLREIPQSVSVITSQQMRDQNIKALDRALLQATGTSRQIYGSDRAGYNYLFARG
              |||||||||||||||||||||||||||||:||||||||||||||||||||||||||||||
orf23-1       PLGLPMTLREIPQSVSVITSQQMRDQNIKTLDRALLQATGTSRQIYGSDRAGYNYLFARG
                      70         80         90        100        110        120

130        140        150        160        170        180
orf23a.pep    SRIANYQINGIPVADALADTGNANTAAYERVEVVRGVAGLLDGTGEPSATVNLVRKRPTR
              |||||||||||||||||||||||||||||||||||||||||||||||||||||||| |||
orf23-1       SRIANYQINGIPVADALADTGNANTAAYERVEVVRGVAGLLDGTGEPSATVNLVRKRLTR
                     130        140        150        160        170        180

190        200        210        220        230        240
orf23a.pep    KPLFEVRAEAGNRKHFGLGADVSGSLNAEGTLRGRLVSTFGRGDSWRQRERSRDAELYGI
              ||||||||||||||||||| ||||||||:|||||||||||||||||| :|||||||||||
orf23-1       KPLFEVRAEAGNRKHFGLDADVSGSLNTEGTLRGRLVSTFGRGDSWRRRERSRDAELYGI
                     190        200        210        220        230        240

250        260        270        280        290        300
orf23a.pep    LEYDIAPQTRVHAGMDYQQAKETADAPLSYAVYDSQGYATAFGPKDNPATNWANSRHRAL
              ||||||||||||||||||||||||||||||||||||||||||||||||||||||||||||
orf23-1       LEYDIAPQTRVHAGMDYQQAKETADAPLSYAVYDSQGYATAFGPKDNPATNWANSRHRAL
                     250        260        270        280        290        300

310        320        330        340        350        360
orf23a.pep    NLFAGIEHRFNQDWKLKAEYDYTRSRFRQPYGVAGVLSIDHNTAATDLIPGYWHADPRTH
              ||||||||||||||||||||||||||||||||||||||||||||||||||||||||||||
orf23-1       NLFAGIEHRFNQDWKLKAEYDYTRSRFRQPYGVAGVLSIDHNTAATDLIPGYWHADPRTH
                     310        320        330        340        350        360

370        380        390        400        410        420
orf23a.pep    SASVSLIGKYRLFGREHDLIAGINGYKYASNKYGERSIIPNAIPNAYEFSRTGAYPQPAS
              ||||||||||||||||||||||||||||||||||||||||||||||||||||||||||||
orf23-1       SASVSLIGKYRLFGREHDLIAGINGYKYASNKYGERSIIPNAIPNAYEFSRTGAYPQPAS
                     370        380        390        400        410        420

430        440        450        460        470        480
orf23a.pep    FAQTIPQYGTRRQIGGYLATRFRAADNLSLILGGRYSRYRTGSYDSRTQGMTYVSANRFT
              |||||||||||||||||||||||||||||||||||:||||||||||||||||||||||||
orf23-1       FAQTIPQYGTRRQIGGYLATRFRAADNLSLILGGRYTRYRTGSYDSRTQGMTYVSANRFT
                     430        440        450        460        470        480

490        500        510        520        530        540
orf23a.pep    PYTGIVFDLTGNLSLYGSYSSLFVPQSQKDEHGSYLKPVTGNNLEAGIKGEWLEGRLNAS
              ||||||||||||||||||||||||||||||||||||||||||||||||||||||||||||
orf23-1       PYTGIVFDLTGNLSLYGSYSSLFVPQSQKDEHGSYLKPVTGNNLEAGIKGEWLEGRLNAS
                     490        500        510        520        530        540

550        560        570        580        590        600
ORF23a.pep    AAVYRARKNNLATAAGRDPSGNTYYRAANQAKTHGWEIEVGGRITPEWQIQAGYSQSKTR
              ||||||||||||||||||||||||||||||||||||||||||||||||||||||||||||
orf23-1       AAVYRARKNNLATAAGRDPSGNTYYRAANQAKTHGWEIEVGGRITPEWQIQAGYSQSKTR
                     550        560        570        580        590        600

610        620        630        640        650        660
orf23a.pep    DQDGSRLNPDSVPERSFKLFTAYHFAPEAPSGWTIGAGVRWQSETHTDPATLRIPNPAAK
              ||||||||||||||||||||||||||||||||||||||||||||||||||||||||||||
orf23-1       DQDGSRLNPDSVPERSFKLFTAYHFAPEAPSGWTIGAGVRWQSETHTDPATLRIPNPAAK
                     610        620        630        640        650        660

670        680        690        700        710        720
orf23a.pep    ARAADNSRQKAYAVADIMARYRFNPRAELSLNVDNLFNKHYRTQPDRHSYGALRTVNAAF
              ||||||||||||||||||||||||||||||||||||||||||||||||||||||||||||
orf23-1       ARAADNSRQKAYAVADIMARYRFNPRAELSLNVDNLFNKHYRTQPDRHSYGALRTVNAAF
                     670        680        690        700        710        720 orf23a.pep    TYRFKX
              ||||||
orf23-1       TYRFKX
```

Homology with a Predicted ORF from *N. gonorrhoeae*
ORF23 shows 93.4% identity over a 211aa overlap with a predicted ORF (ORF23.ng) from *N. gonorrhoeae*:

```
orf23.pep             GYNYLFARGSRIANYQINGIPVADALADTGNANTAAYERVEVVRGVAGLLD    51
                      ||||||||||||||||||||||||||||||||||||||||||||||||:|
orf23ng      SAVDACRIPGYNYLFARGSRIANYQINGIPVADALADTGNANTAAYERVEVVRGVAGLPD    60
orf23.pep    GTGEPSATVNLVRKRLTRKPLFEVRAEAGNRKHFGLDADVSGSLNTEXXLRGRLVSTFGR   111
             ||||||||||||||:|||||||||||||||||||||||:||||||||:  :|||||||||
orf23ng      GTGEPSATVNLVRKHPTRKPLFEVRAEAGNRKHFGLGADVSGSLNAEGTLRGRLVSTFGR   120
orf23.pep    GDSWRRRERSRXAELYGILEYDIAPQTRVHAXMDYQQAKETADAPLSYAVYDSQGYATAF   171
             |||||:|||||:||||||||||||||||||| |||||||||||||||||||||||||||
orf23ng      GDSWRQLERSRDAELYGILEYDIAPQTRVHAGMDYQQAKETADAPLSYAVYDSQGYATAF   180
orf23.pep    GPKDNPATNWANSHHRALNLFAGIEHRFNQDWKLKAEYDY                      211
             |||||||||| :||::|||||||||||||||||||||||
orf23ng      GPKDNPATNWSNSRNRALNLFAGIEHRFNQDWKLKAEYDYTRSRFRQPYGVAGVLSIDHS   240
```

The ORF23ng nucleotide sequence <SEQ ID 669> is predicted to encode a protein comprising amino acid sequence <SEQ ID 670>:

```
  1 SAVDACRIPG YNYLFARGSR IANYQINGIP VADALADTGN ANTAAYERVE
 51 VVRGVAGLPD GTGEPSATVN LVRKHPTRKP LFEVRAEAGN RKHFGLGADV
101 SGSLNAEGTL RGRLVSTFGR GDSWRQLERS RDAELYGILE YDIAPQTRVH
151 AGMDYQQAKE TADAPLSYAV YDSQGYATAF GPKDNPATNW SNSRNRALNL
201 FAGIEHRFNQ DWKLKAEYDY TRSRFRQPYG VAGVLSIDHS TAATDLIPGY
251 WHADPRTHSA SMSLTGKYRL FGREHDLIAG INGYKYASNK YGERSIIPNA
301 IPNAYEFSRT GAYPQPSSFA QTIPQYDTRR QIGGYLATRF RAADNLSLIL
351 GGRYSRYRAG SYNSRTQGMT YVSANRFTPY TGIVFDLTGN LSLYGSYSSL
401 FVPQLQKDEH GSYLKPVTGN NLEADIKGEW LEGRLNASAA VYRARKNNLA
451 TAAGRDQSGN TYYRAANQAK THGWEIEVGG RITPEWQIQA GYSQSKPRDQ
501 DGSRLNPDSV PERSFKLFTA YHLAPEAPSG RTIGAGVRRQ GETHTDPAAL
551 RIPNPAAKAR AVANSRQKAY AVADIMARYR FNPRTELSLN VDNLFNKHYR
601 TQPDRHSYGA LRTVNAAFTY RFK*
```

Further work revealed the complete nucleotide sequence <SEQ ID 671>:

```
  1 ATGACACGCT TCAAATACTC CCTGCTTTTT GCCGCCCTGC TACCCGTGTA
 51 CGCGCAGGCC GATGTTTCTG TTTCAGACGA CCCCAAACCG CAGGAAAGCA
101 CCGAATTGCC GACCATCACC GTTACCGCCG ACCGCACCGC GAGTTCCAAC
151 GACGGCTACA CCGTTTCCGG CACGCACACC CCGTTCGGGC TGCCCATGAC
201 CCTGCGCGAA ATCCCGCAGA GCGTCAGCGT CATCACATCG CAACAAATGC
251 GCGACCAAAA CATCAAAACG CTCGACCGCG CCCTGTTGCA GGCGACCGGC
301 ACCAGCCGCC AGATTTACGG CTCCGACCGC GCGGGCTACA ACTACCTGTT
351 CGCGCGCGGC AGCCGCATCG CCAACTACCA AATCAACGGC ATCCCCGTTG
401 CCGACGCGCT GGCCGATACG GGCAATGCCA ACACCGCCGC CTATGAGCGC
451 GTAGAAGTCG TGCGCGGCGT GGCGGGGCTG CCGGACGGCA CGGGCGAGCC
501 TTCTGCCACC GTCAATCTGG TACGCAAACA CCCGACCCGC AAGCCATTGT
```

-continued

```
 551 TTGAAGTCCG CGCCGAAGCC GGCAACCGCA AACATTTCGG GCTGGGCGCG
 601 GACGTATCGG GCAGCCTGAA CGCCGAAGGC ACGCTGCGCG CCGCCTGGT
 651 TTCCACCTTC GGACGCGGCG ACTCGTGGCG GCAGCTCGAA CGCAGCCGCG
 701 ATGCCGAACT CTACGGCATT TTGGAATACG ACATCGCACC GCAAACCCGC
 751 GTCCACGCAG GCATGGACTA CCAGCAGGCG AAAGAAACCG CAGACGCGCC
 801 GCTCAGCTAC GCCGTGTACG ACAGCCAAGG TTATGCCACC GCCTTCGGCC
 851 CAAAAGACAA CCCCGCCACA AATTGGTCGA ACAGCCGCAA CCGTGCGCTC
 901 AACCTGTTCG CCGGCATAGA ACACCGCTTC AACCAAGACT GGAAACTCAA
 951 AGCCGAATAC GACTACACCC GTAGCCGCTT CCGCCAGCCC TACGGTGTGG
1001 CAGGCGTACT TTCCATCGAC CACAGCACTG CCGCCACCGA CCTGATTCCC
1051 GGTTATTGGC ACGCcgatcc GCGCACCCAC AGCGCCAGCA TGTCATTGAC
1101 CGGCAAATAC CgcctGTTCG GCCGCGAGCA CGATTTAATC GCGGGTATCA
1151 ACGGCTACAA ATACGCCAGC AACAAATACG GCGAACGCAG CATCATTCCC
1201 AACGCCATTC CCAACGCCTA CGAATTTTCC CGCACGGGCG CCTATCCGCA
1251 GCCATCATCG TTTGCCCAAA CCATCCCGCA ATACGACACC AGGCGGCAAA
1301 TCGGCGGCTA TCTCGCCACC CGTTTCCGCG CCGCCGACAA CCTTTCGCTG
1351 ATACTCGGCG GCAGATACAG CCGCTACCGC GCAGGCAGCT ACAACAGCCG
1401 CACACAAGGC ATGACCTATG TGTCCGCCAA CCGTTTCACC CCCTACACAG
1451 GCATCGTGTT CGATCTGACC GGCAACCTGT CGCTTTACGG CTCGTACAGC
1501 AGCCTGTTCG TCCCGCAATT GCAAAAAGAC GAACACGGCA GCTACCTGAA
1551 ACCCGTAACC CGCAACAATC TGGAAGCCGA CATCAAAGGC GAATGGCTTG
1601 AAGGGCGTCT GAACGCATCC GCCGCCGTGT ACCGCGCCCG TAAAAACAAC
1651 CTCGCCACCG CAGCAGGACG CGACCAGAGC GGCAACACCT ACTATCGCGC
1701 CGCCAACCAA GCCAAAACCC ACGGCTGGGA AATCGAAGTC GGCGGCCGCA
1751 TCACGCCCGA ATGGCAGATA CAGGCAGGCT ACAGCCAAAG CAAACCCCGC
1801 GACCAAGACG GCAGCCGCCT GAACCCCGAC AGCGTAcCCG AACGCAGCTT
1851 CAAACTCTTC ACCGCCTACC ACTTAGCCCC CGAAGCCCCC AGCGGCCGGA
1901 CCATcggTGC GGGTGTGCGC CGGCAGGGCG AAACCCACAC CGACCCAGCC
1951 GCGCTCCGCA TCCCCAACCC CGCCGCCAAA GCCCGCGCCG TCGCCAACAG
2001 CCGCCAGAAA GCCTACGCCG TCGCCGACAT CATGGCGCGT TACCGCTTCA
2051 ATCCGCGCAC CGAACTGTCG CTGAACGTGG ACAACCTGTT CAACAAACAC
2101 TACCGCACCC AGCCCGACCG CCACAGCTAC GGCGCACTGC GGACAGTGAA
2151 CGCGGCGTTT ACCTATCGGT TTAAATAA
```

This corresponds to the amino acid sequence <SEQ ID 672; ORF23ng-1>:

```
  1 MTRFKYSLLF AALLPVYAQA DVSVSDDPKP QESTELPTIT VTADRTASSN
 51 DGYTVSGTHT PFGLPMTLRE IPQSVSVITS QQMRDQNIKT LDRALLQATG
101 TSRQIYGSDR AGYNYLFARG SRIANYQING IPVADALADT GNANTAAYER
```

-continued
```
151 VEVVRGVAGL PDGTGEPSAT VNLVRKHPTR KPLFEVRAEA GNRKHFGLGA

201 DVSGSLNAEG TLRGRLVSTF GRGDSWRQLE RSRDAELYGI LEYDIAPQTR

251 VHAGMDYQQA KETADAPLSY AVYDSQGYAT AFGPKDNPAT NWSNSRNRAL

301 NLFAGIEHRF NQDWKLKAEY DYTRSRFRQP YGVAGVLSID HSTAATDLIP

351 GYWHADPRTH SASMSLTGKY RLFGREHDLI AGINGYKYAS NKYGERSIIP

401 NAIPNAYEFS RTGAYPQPSS FAQTIPQYDT RRQIGGYLAT RFRAADNLSL

451 ILGGRYSRYR AGSYNSRTQG MTYVSANRFT PYTGIVFDLT GNLSLYGSYS

501 SLFVPQLQKD EHGSYLKPVT GNNLEADIKG EWLEGRLNAS AAVYRARKNN

551 LATAAGRDQS GNTYYRAANQ AKTHGWEIEV GGRITPEWQI QAGYSQSKPR

601 DQDGSRLNPD SVPERSFKLF TAYHLAPEAP SGRTIGAGVR RQGETHTDPA

651 ALRIPNPAAK ARAVANSRQK AYAVADIMAR YRFNPRTELS LNVDNLFNKH

701 YRTQPDRHSY GALRTVNAAF TYRFK*
```

ORF23ng-1 and ORF23-1 show 95.9% identity in 725 aa overlap:

```
                      10         20         30         40         50         60
       orf23-1.pep    MTRFKYSLLFAALLPVYAQADVSVSDDPKPQESTELPTIITVTADRTASSNDGYTVSGTHT
                      ||||||||||||||||||||||||||||||||||||||||||||||||||||||||||||
       orf23ng-1      MTRFKYSLLFAALLPVYAQADVSVSDDPKPQESTELPTIITVTADRTASSNDGYTVSGTHT
                      10         20         30         40         50         60
                      70         80         90         100        110        120
       orf23-1.pep    PLGLPMTLREIPQSVSVITSQQMRDQNIKTLDRALLQATGTSRQIYGSDRAGYNYLFARG
                      |:||||||||||||||||||||||||||||||||||||||||||||||||||||||||||
       orf23ng-1      PFGLPMTLREIPQSVSVITSQQMRDQNIKTLDRALLQATGTSRQIYGSDRAGYNYLFARG
                      70         80         90         100        110        120
                      130        140        150        160        170        180
       orf23-1.pep    SRIANYQINGIPVADALADTGNANTAAYERVEVVRGVAGLLDGTGEPSATVNLVRKRLTR
                      |||||||||||||||||||||||||||||||||||||||||:||||||||||||||:||
       orf23ng-1      SRIANYQINGIPVADALADTGNANTAAYERVEVVRGVAGLPDGTGEPSATVNLVRKHPTR
                      130        140        150        160        170        180
                      190        200        210        220        230        240
       orf23-1.pep    KPLFEVRAEAGNRKHFGLDADVSGSLNTEGTLRGRLVSTFGRGDSWRRRERSRDAELYGI
                      ||||||||||||||||||||:|||||||:|||||||||||||||||:|:|||||||||||
       orf23ng-1      KPLFEVRAEAGNRKHFGLGADVSGSLNAEGTLRGRLVSTFGRGDSWRQLERSRDAELYGI
                      190        200        210        220        230        240
                      250        260        270        280        290        300
       orf23-1.pep    LEYDIAPQTRVHAGMDYQQAKETADAPLSYAVYDSQGYATAFGPKDNPATNWANSRHRAL
                      ||||||||||||||||||||||||||||||||||||||||||||||||||||:|:|:|||
       orf23ng-1      LEYDIAPQTRVHAGMDYQQAKETADAPLSYAVYDSQGYATAFGPKDNPATNWSNSRNRAL
                      250        260        270        280        290        300
                      310        320        330        340        350        360
       orf23-1.pep    NLFAGIEHRFNQDWKLKAEYDYTRSRFRQPYGVAGVLSIDHNTAATDLIPGYWHADPRTH
                      ||||||||||||||||||||||||||||||||||||||||||:||||||||||||||||
       orf23ng-1      NLFAGIEHRFNQDWKLKAEYDYTRSRFRQPYGVAGVLSIDHSTAATDLIPGYWHADPRTH
                      310        320        330        340        350        360
                      370        380        390        400        410        420
       orf23-1.pep    SASVSLIGKYRLFGREHDLIAGINGYKYASNKYGERSIIPNAIPNAYEFSRTGAYPQPAS
                      |||:|:|||||||||||||||||||||||||||||||||||||||||||||||||||:|
       orf23ng-1      SASMSLTGKYRLFGREHDLIAGINGYKYASNKYGERSIIPNAIPNAYEFSRTGAYPQPSS
                      370        380        390        400        410        420
                      430        440        450        460        470        480
       orf23-1.pep    FAQTIPQYGTRRQIGGYLATRFRAADNLSLILGGRYTRYRTGSYDSRTQGMTYVSANRFT
                      ||||||||:||||||||||||||||||||||||||:|:|||:|||:|||||||||||||
       orf23ng-1      FAQTIPQYDTRRQIGGYLATRFRAADNLSLILGGRYSRYRAGSYNSRTQGMTYVSANRFT
                      430        440        450        460        470        480
                      490        500        510        520        530        540
       orf23-1.pep    PYTGIVFDLTGNLSLYGSYSSLFVPQSQKDEHGSYLKPVTGNNLEAGIKGEWLEGRLNAS
                      |||||||||||||||||||||||||||:|||||||||||||||||||:|||||||||||
       orf23ng-1      PYTGIVFDLTGNLSLYGSYSSLFVPQLQKDEHGSYLKPVTGNNLEADIKGEWLEGRLNAS
                      490        500        510        520        530        540
                      550        560        570        580        590        600
       orf23-1.pep    AAVYRARKNNLATAAGRDPSGNTYYRAANQAKTHGWEIEVGGRITPEWQIQAGYSQSKTR
                      |||||||||||||||||||:||||||||||||||||||||||||||||||||||||||||
       orf23ng-1      AAVYRARKNNLATAAGRDQSGNTYYRAANQAKTHGWEIEVGGRITPEWQIQAGYSQSKPR
                      550        560        570        580        590        600
```

```
                          -continued
                  610        620        630        640        650        660
orf23-1.pep    DQDGSRLNPDSVPERSFKLFTAYHFAPEAPSGWTIGAGVRWQSETHTDPATLRIPNPAAK
               ||||||||||||||||||||||||:|||||||:||||||||:|||||||:||||||||||
orf23ng-1      DQDGSRLNPDSVPERSFKLFTAYHLAPEAPSGRTIGAGVRRQGETHTDPAALRIPNPAAK
                  610        620        630        640        650        660

670        680        690        700        710        720
orf23-1.pep    ARAADNSRQKAYAVADIMARYRFNPRAELSLNVDNLFNKHYRTQPDRHSYGALRTVNAAF
               |||:||||||||||||||||||||||||:|||||||||||||||||||||||||||||||
orf23ng-1      ARAVANSRQKAYAVADIMARYRFNPRTELSLNVDNLFNKHYRTQPDRHSYGALRTVNAAF
                  670        680        690        700        710        720 orf23-1.pep    TYRFKX
               ||||||
of23ng-1       TYRFKX
```

In addition, ORF1ing-1 shows significant homology with an OMP from *E. coli*:

```
sp|P16869|FHUE_ECOLI OUTER-MEMBRANE RECEPTOR FOR FE(III)-COPROGEN,
FE (III)-FERRIOXAMINE B AND FE(III)-RHODOTRULIC ACID PRECURSOR
>gi|1651542|gnl|PID|d1015403 (D90745) Outer membrane protein FhuE
precursor [Escherichia coli] >gi|1651545|gnl|PID|d1015405 (D90746)
Outer membrane protein FhuE precursor [Escherichia coli] >gi|1787344
(AE000210) outer-membrane receptor for Fe(III)-coprogen, Fe(III)-
ferrioxamine B and Fe(III)-rhodotrulic acid precursor [Escherichia
coli] Length = 729
Score = 332 bits (843), Expect = 3e - 90
Identities = 228/717 (31%), Positives = 350/717 (48%), Gaps = 60/717 (8%)

Query:  38 TITVTADRTASSN--DGYTVSGTHTPFGLPMTLREIPQSVSVITSQQMRDQNIKTLDRAL   95
           T+ V    TA +  + Y+V+ T    + MT R+IPQSV++++ Q+M DQ ++TL   +
Sbjct:  43 TVIVEGSATAPDDGENDYSVTSTSAGTKMQMTQRDIPQSVTIVSQQRMEDQQLQTLGEVM 102

Query:  96 LQATGTSRQIYGSDRAGYNYLFARGSRIANYQINGIP--------VADALADTGNANTAA 147
              G S+    SDRA Y   ++RG +I NY ++GIP         + DAL+D     A
Sbjct: 103 ENTLGISKSQADSDRALY---YSRGFQIDNYMVDGIPTYFESRWNLGDALSDM------AL 154

Query: 148 YERVEVVRGVAGLPDGTGEPSATVNLVRKHPTRKPLF-EVRAEAGNRKHFGLGADVSGSL 206
           +ERVEVVRG  GL TG PSA +N+VRKH T +     +V AE G+          AD+  L
Sbjct: 155 FERVEVVRGATGLMTGTGNPSAAINMVRKHATSREFKGDVSAEYGSWNKERYVADLQSPL 214

Query: 207 NAEGTLRGRLVSTFGRGDSWRQLERSRDAELYGILEYDIAPQTRVHAGMDYQQAKETADA 266
            +G +R R+V +   DSW    S      GI++ D+    T + AG +YQ+    +
Sbjct: 215 TEDGKIRARIVGGYQNNDSWLDRYNSEKTFFSGIVDADLGDLTTLSAGYEYQRIDVNSPT 274

Query: 267 PLSYAVYDSQGYATAFGPKDNPATNWSNSRNRALNLFAGIEHRFNQDWKLKAEYDYTRSR 326
                +++ G + ++    + A +W+ +    +F ++ +F    W+     ++
Sbjct: 275 WGGLPRWNTDGSSNSYDRARSTAPDWAYNDKEINKVFMTLKQQFADTWQATLNATHSEVE 334

Query: 327 F--RQPYGVAGVLSIDHSTAA--TDLIPGY-------WHADPRTHSA-SMSLTGKYRLFG 374
           F    + Y AV  D      ++ PG+          W++  R  A   G Y LFG
Sbjct: 335 FDSKMMYVDAYVNKADGMLVGPYSNYGPGFDYVGGTGWNSGKRKVDALDLFADGSYELFG 394

Query: 375 REHDLIAGINGYKYASNKYGER--SIIPNAIPNAYEFSRTGAYPQPSSFAQTIPQYDTRR 432
           R+H+L+ G    Y   +N+Y    +I P+ I + Y F+  G  PQ    Q++ Q DT
Sbjct: 395 RQHNLMFG-GSYSKQNNRYFSSWANIFPDEIGSFYNFN--GNFPQTDWSPQSLAQDDTTH 451

Query: 433 QIGGYLATRFRAADNLSLILGGRYSRYRAGSYNSRTQGMTY-VSANRFTPYTGIVFDXXX 491
              Y ATR   AD L LILG RY+ +R +      +TY + N  TPY G+VFD
Sbjct: 452 MKSLYAATRVTLADPLHLILGARYTNWRVDT-------LTYSMEKNHTTPYAGLVFDIND 504

Query: 492 XXXXXXXXXXXFVPQLQKDEHGSYLKPVTGNNLEADIKGEWLEGRLNASAAVYRARKNNL 551
                      F PQ +D  G YL P+TGNN E   +K +W+  RL   A++R   ++N+
Sbjct: 505 NWSTYASYTSIFQPQNDRDSSGKYLAPITGNNYELGLKSDWMNSRLTTTLAIFRIEQDNV 564

Query: 552 ATAAGR---DQSGNTYYRAANQAKTHGWEIEVGGRITPEWQIQAGYSQSKPRDQDGSRLN 608
           A + G       +G T Y+A +   + G E E+ G IT  WQ+  G ++     D+ G +N
Sbjct: 565 AQSTGTPIPGSNGETAYKAVDGTVSKGVEFELNGAITDNWQLTFGATRYIAEDNEGNAVN 624

Query: 609 PDSVPERSFKLFTAYHLAPEAPSGRTIGAGVRRQGETHTDPAALRIPNPAAKARAVANSR 668
           P ++P + K+FT+Y L P   P    T+G GV Q    +TD         P      RA
Sbjct: 625 P-NLPRTTVKMFTSYRL-PVMPE-LTVGGGVNWQNRVYTDTV-----TPYGTFRA----E 672

Query: 669 QKAYAVADIMARYRFNPRTELSLNVDNLFNKHYRTQPDRH-SYGALRTVNAAFTYRF    724
           Q +YA+ D+  RY+      L  NV+NLF+K Y T  +    YG R +   TY+F
Sbjct: 673 QGSYALVDLFTRYQVTKNFSLQGNVNNLFDKTYDTNVEGSIVYGTPRNFSITGTYQF    729
```

Based on this analysis, it was predicted that these proteins from *N. meningitidis* and *N. gonorrhoeae*, and their epitopes, could be useful antigens for vaccines or diagnostics, or for raising antibodies.

ORF23-1 (77.5 kDa) was cloned in pET and pGex vectors and expressed in *E. coli*, as described above. The products of protein expression and purification were analyzed by SDS-PAGE. FIG. 15A shows the results of affinity purification of the His-fusion protein, and FIG. 15B shows the results of expression of the GST-fusion in *E. coli*. Purified His-fusion protein was used to immunise mice, whose sera were used for Western blot (FIG. 15C) and for ELISA (positive result). These experiments confirm that ORF23-1 is a surface-exposed protein, and that it is a useful immunogen.

Example 80

The following partial DNA sequence was identified in *N. meningitidis* <SEQ ID 673>:

```
  1 ATGCGCACGG CAGTGGTTTT GCTGTTGATC ATGCCGATGG CGGCTTCGTC
 51 GGCAATGATG CCGGAAATGG TGTGCGCGGG CGTGTCGCCG GGAACGGCAA
101 TCATATCCAA GCCGACCGAA CAAACGGCGG TCATGGCTTC GAGTTTGTCC
151 AGCGTCAgcA CGCCTGCTTC GGCGgcGgCa ATCATACCTT CGTCTTCGGA
201 AACGGGGATA AACGcGCCAC TCAAACCCCC GACCGCGCTG GAAGCCATCA
251 TGCCGCCTTT TTTCACGGCA TCGTTCAGCA ATGCCAAAGC TGCTGTTGTG
301 CCGTGCGTAC CGCAGACGCT CAAGCCCATT TnTTCAAGAA TGCGTGCCAC
351 TnAGTCGCCG ACGGGG..
```

This corresponds to the amino acid sequence <SEQ ID 674; ORF24>:

```
  1 MRTAVVLLLI MPMAASSAMM PEMVCAGVSP GTAIISKPTE QTAVMASSLS
 51 SVSTPASAAA IIPSSSETGI NAPLKPPTAL EAIMPPFFTA SFSNAKAAVV
101 PCVPQTLKPI XSRMRATXSP TG..
```

Further work revealed the complete nucleotide sequence <SEQ ID 675>:

```
  1 ATGCGCACGG CAGTGGTTTT GCTGTTGATC ATGCCGATGG CGGCTTCGTC
 51 GGCAATGATG CCGGAAATGG TCTGCGCGGG CGTGTCGCCG GGAACGGCAA
101 TCATATCCAA GCCGACCGAA CAAACGGCGG TCATGGCTTC GAGTTTGTCC
151 AGCGTCAGCA CGCCTGCTTC GGCGGCGGCA ATCATACCTT CGTCTTCGGA
201 AACGGGGATA AACGCGCCAC TCAAACCCCC GACCGCGCTG GAAGCCATCA
251 TGCCGCCTTT TTTCACGGCA TCGTTCAGCA ATGCCAAAGC TGCTGTTGTG
301 CCGTGCGTAC CGCAGACGCT CAAGCCCATT TCTTCAAGAA TGCGTGCCAC
351 TGAGTCGCCG ACGGCGGGG TCGGCGCCAG CGACAAGTCG AGAATACCAA
401 ACGGGATATT CAGCATTTTT GAGGCTTCGC GGCCGATGAG TTCGCCCACG
451 CGGGTAATTT TGAAAGCAGT TTTCTTCACT ACTTCCGCAA CTTCGGTCAA
501 TGTCGTTGCA TCTGAATTTT CCAACGCGGC TTTTACGACA CCTGGGCCGG
551 ATACGCCGAC ATTGATAACG GCATCCGCTT CGCCCGAACC ATGAAACGCG
601 CCCGCCATAA ACGGGTTGTC TTCCACCGCG TTGCAGAACA CGACAATTTT
651 AGCGCAGCCG AAACCTTCGG GCGTGATTTC CGCCGTGCGT TTGACGGTTT
701 CGCCCGCCAG CTTGACCGCA TCCATATTGA TACCGGCACG CGTACTGCCG
751 ATATTGATGG AGCTGCACAC AATATCGGTA GTCTTCATCG CTTCGGGAAT
```

```
801 GGAGCGGATT AACACCTCAT CCCAAGGCGA CATCCCTTTT TGCACCAACG

851 CGGAAAAACC GCCGATAAAA GACACACCGA TGGCTTTGGC AGCTTTATCC

901 AAAGTTTGCG CCACGCTGAC GTAA
```

This corresponds to the amino acid sequence <SEQ ID 676; ORF24-1>:

```
  1 MRTAVVLLLI MPMAASSAMM PEMVCAGVSP GTAIISKPTE QTAVMASSLS

51 SVSTPASAAA IIPSSSETGI NAPLKPPTAL EAIMPPFFTA SFSNAKAAVV

101 PCVPQTLKPI SSRMRATESP TAGVGASDKS RIPNGIFSIF EASRPMSSPT

151 RVILKAVFFT TSATSVNVVA SEFSNAAFTT PGPDTPTLIT ASASPEP*NA

201 PAINGLSSTA LQNTTILAQP KPSGVISAVR LTVSPASLTA SILIPARVLP

251 ILMELHTISV VFIASGMERI NTSSEGDIPF CTNAEKPPIK DTPMALAALS

301 KVCATLT*
```

Computer analysis of this amino acid sequence gave the 25 following results:

Homology with a Predicted ORF from *N. meningitidis* (Strain A)

ORF24 shows 96.4% identity over a 307 aa overlap with an ORF (ORF24a) from strain A of *N. meningitidis*:

```
                      10        20        30        40        50        60
    orf24a.pep  MRTAVVLLLIMPMAASSAMMPEMVCAGVSPGTAIISXPTEQTAVIASSLSNVSTPASAAA
                ||||||||||||||||||||||||||||||||||| :||||:||||| ||||||||||||
    orf24       MRTAVVLLLIMPMAASSAMMPEMVCAGVSPGTAIISKPTEQTAVMASSLSSVSTPASAAA
                      10        20        30        40        50        60
                      70        80        90       100       110       120
    orf24a.pep  IIPSSSXTGINAPLKPPTALEAIMPPFFTASFSNAKAAVVPCVPQTLKPISSRMRATESP
                ||||||:||||||||||||||||||||||||||||||||||||||||||||||||||||
    orf24       IIPSSSETGINAPLKPPTALEAIMPPFFTASFSNAKAAVVPCVPQTLKPISSRMRATESP
                      70        80        90       100       110       120
                     130       140       150       160       170       180
    orf24a.pep  TAGVGASDKSRIPNGIFSIFEASRPMSSPTRVILKAVFFTSATSVNVVASEFSNAAFTT
                |||||||||||||||||||||||||||||||||||||||||||||||||||||||||||
    orf24       TAGVGASDKSRIPNGIFSIFEASRPMSSPTRVILKAVFFTSATSVNVVASEFSNAAFTT
                     130       140       150       160       170       180
                     190       200       210       220       230       240
    orf24a.pep  PGPDTPTLITASASPEPXNAPAIXGLSSXALQNTTILAQPKPSSVISXVRLMVSPASLTA
                ||||||||||||||||||||||||:|||| ||||||||||||| ||||:| || ||||||
    orf24       PGPDTPTLITASASPEPXNAPAINGLSSTALQNTTILAQPKPSGVISAVRLTVSPASLTA
                     190       200       210       220       230       240
                     250       260       270       280       290       300
    orf24a.pep  SILIPARVLPILMELHTISVVFIASGMERXNTSSEGDIPFCTSAEKPPIKDTPMALAALS
                |||||||||||||||||||||||||||||:||||||||||||| |||||||||||||||
    orf24       SILIPARVLPILMELHTISVVFIASGMERINTSSEGDIPFCTNAEKPPIKDTPMALAALS
                     250       260       270       280       290       300 orf24a.pep  KVCATLTX
                ||||||||
    orf24       KVCATLTX
```

The complete length ORF24a nucleotide sequence <SEQ ID 677> is:

```
  1 ATGCGCACGG CAGTGGTTTT GCTGTTGATC ATGCCGATGG CGGCTTCGTC

51 GGCAATGATG CCGGAAATGG TGTGCGCGGG TGTGTCGCCG GGAACGGCAA
```

-continued

```
101 TCATATCCAA NCCGACCGAA CAAACGGCGG TCATCGCTTC GAGTTTATCC

151 AACGTCAGCA CGCCTGCTTC GGCGGCGGCA ATCATACCTT CGTCTTCGGA

201 NACGGGGATA AACGCGCCAC TCAAACCGCC AACCGCGCTC GAAGCCATCA

251 TGCCGCCCTT TTTCACGGCA TCGTTCAGCA ATGCCAAAGC TGCTGTTGTG

301 CCGTGCGTAC CGCAGACGCT CAAACCCATT TCTTCAAGAA TGCGCGCCAC

351 CGAGTCGCCG ACGGCAGGGG TCGGTGCCAG CGACAAGTCG AGAATACCAA

401 ACGGGATATT CAGCATTTTT GAGGCTTCGC GGCCGATGAG TTCGCCCACG

451 CGGGTAATTT TGAAGGCGGT TTTCTTCACA ACTTCGGCAA CTTCGGTCAA

501 TGTCGTTGCA TCCGAATTTT CCAACGCGGC TTTTACGACA CCCGGGCCGG

551 ATACGCCGAC ATTAATCACA GCATCCGCTT CGCCTGAGCC GTGAAACGCG

601 CCCGCCATAN ACGGGTTGTC TTCCNCCGCG TTGCAGAACA CGACGATTTT

651 GGCGCAGCCG AAACCTTCTA GTGTGATTTC ANCCGTGCGT TTGATGGTTT

701 CGCCCGCCAG TCTGACCGCG TCCATATTGA TACCGGCGCG CGTACTGCCG

751 ATATTGATGG AGCTGCACAC GATATCAGTA GTCTTCATCG CTTCGGGAAT

801 GGAACGGATN AACACCTCGT CAGAAGGCGA CATACCTTTT TGCACCAGCG

851 CGGAAAAGCC GCCAATAAAA GACACGCCGA TGGCTTTGGC AGCCTTATCC

901 AAAGTTTGCG CCACGCTGAC GTAA
```

This encodes a protein having amino acid sequence <SEQ ID 678>:

```
  1 MRTAVVLLLI MPMAASSAMM PEMVCAGVSP GTAIISXPTE QTAVIASSLS

51 NVSTPASAAA IIPSSSXTGI NAPLKPPTAL EAIMPPFFTA SFSNAKAAVV

101 PCVPQTLKPI SSRMRATESP TAGVGASDKS RIPNGIFSIF EASRPMSSPT

151 RVILKAVFFT TSATSVNVVA SEFSNAAFTT PGPDTPTLIT ASASPEP*NA

201 PAIXGLSSXA LQNTTILAQP KPSSVISXVR LMVSPASLTA SILIPARVLP

251 ILMELHTISV VFIASGMERX NTSSEGDIPF CTSAEKPPIK DTPMALAALS

301 KVCATLT*
```

It should be noted that this protein includes a stop codon at position 198.

ORF24a and ORF24-1 show 96.4% identity in 307 aa overlap:

```
                    10         20         30         40         50         60
   orf24a.pep  MRTAVVLLLIMPMAASSAMMPEMVCAGVSPGTAIISXPTEQTAVIASSLSNVSTPASAAA
                ||||||||||||||||||||||||||||||||||||| ||||| :|||| :||||||||||
   orf24-1     MRTAVVLLLIMPMAASSAMMPEMVCAGVSPGTAIISKPTEQTAVMASSLSSVSTPASAAA
                    10         20         30         40         50         60

70         80         90        100        110        120
   orf24a.pep  IIPSSSXTGINAPLKPPTALEAIMPPFFTASFSNAKAAVVPCVPQTLKPISSRMRATESP
                |||||| ||||||||||||||||||||||||||||||||||||||||||||||||||||
   orf24-1     IIPSSSETGINAPLKPPTALEAIMPPFFTASFSNAKAAVVPCVPQTLKPISSRMRATESP
                    70         80         90        100        110        120

130        140        150        160        170        180
   orf24a.pep  TAGVGASDKSRIPNGIFSIFEASRPMSSPTRVILKAVFFTTSATSVNVVASEFSNAAFTT
                ||||||||||||||||||||||||||||||||||||||||||||||||||||||||||||
   orf24-1     TAGVGASDKSRIPNGIFSIFEASRPMSSPTRVILKAVFFTTSATSVNVVASEFSNAAFTT
                   130        140        150        160        170        180
```

-continued

```
                  190       200       210       220       230       240
orf24a.pep    PGPDTPTLITASASPEPXNAPAIXGLSSXALQNTTILAQPKPSSVISXVRLMVSPASLTA
              ||||||||||||||||||||| |||:|||||||||||||:||| ||| ||||||||
orf24-1       PGPDTPTLITASASPEPXNAPAINGLSSTALQNTTILAQPKPSGVISAVRLTVSPASLTA
                  190       200       210       220       230       240

250       260       270       280       290       300
orf24a.pep    SILIPARVLPILMELHTISVVFIASGMERXNTSSEGDIPFCTSAEKPPIKDTPMALAALS
              |||||||||||||||||||||||||||||| ||||||||||||||:|||||||||||||
orf24-1       SILIPARVLPILMELHTISVVFIASGMERINTSSEGDIPFCTNAEKPPIKDTPMALAALS
                  250       260       270       280       290       300 orf24a.pep    KVCATLTX
              ||||||||
orf24-1       KVCATLTX
```

Homology with a Predicted ORF from *N. gonorrhoeae*

ORF24 shows 96.7% identity over a 121 aa overlap with a predicted ORF (ORF24ng) from *N. gonorrhoeae*:

```
orf24.pep     MRTAVVLLLIMPMAASSAMMPEMVCAGVSPGTAIISKPTEQTAVMASSLSSVSTPASAAA   60
              |||||||||||||||||||||||||||||||||:||||||||||||||||||:||||||
orf24ng       MRTAVVLLLIMPMAASSAMMPEMVCAGVSPGTAIMSKPTEQTAVMASSLSSVNTPASAAA   60
orf24.pep     IIPSSSETGINAPLKPPTALEAIMPPFFTASFSNAKAAVVPCVPQTLKPIXSRMRATXSP  120
              |||||||||||||||||||||||||||||||||||||||||||||||||| |||||| ||
orf24ng       IIPSSSETGINAPLKPPTALEAIMPPFFTASFSNAKAAVVPCVPQTLKPISSRMRATESP  120
orf24.pep     TG                                                           122
              |:
orf24ng       TAGVGASDKSRMPNGIFSIFEASRPMSSPTRVILKAVFFTTSATSVRLTASEFSSAALTT  180
```

The complete length ORF24ng nucleotide sequence <SEQ ID 679> is:

```
  1 ATGCGCACGG CGGTGGTTTT GCTGTTGATC ATGCCGATGG CGGCTTCGTC

51 GGCGATGATG CCGGAAATGG TGTGCGCGGG CGTGTCGCCG GGAACGGCAA

101 TCATGTCCAA ACCAACGGAG CAGACGGCGG TCATGGCTTC GAGTTTGTCC

151 AGCGTCAACA CGCCTGCCTC GGCGGCGGCA ATCATACCTT CGTCTTCGGA

201 AACGGGGATA AACGCGCCGC TCAAACCGCC GACCGCGCTG AAGCCATCA

251 TGCCGCCCTT TTTCACGGCA TCGTTCAGCA ATGCCAAAGC TGCTGTTGTG

301 CCGTGCGTAC CGCAGACGCT CAAGCCCATT TCTTCAAGAA TGCGCGCCAC

351 CGAGTCGCCG ACGGCGGGGG TCGGTGCCAG CGACAAATCG AGAATGCCGA

401 ACGGGATATT CAGCATTTTT GAGGCTTCGC GACCGATGAG TTCGCCCACG

451 CGGGTGATTT TGAAAGCGGT TTTCTTCACG ACTTCGGCGA CCTCGGTCAG

501 GCTGACCGCG TCCGAATTTT CCAGCGCGGC TTTGACCACG CCTGGACCGG

551 ATACGCCGAC ATTAATCACA GCATCCGCTT CGCCCGAGCC GTGGAACGCA

601 CCCGCCATAA ACGGATTGTC TTCCACCGCG TTGCAGAACA CGACGATTTT

651 GGCGCAGCCG AAACCTTCGG GTGTGATTTC AGCCGTGCGT TTGATGGTTT

701 CGCCTGCCAG CTTGACCGCA TCCATATTGA TACCGGCACG CGTGCTGCCG

751 ATATTGATGG AGCTGCACAC GATATCGGTA GTTTTCATCG CTTCGGGAAC

801 GGAACGGATC AACACCTCAT CCGAAGGCGA CATACCTTTT TGCACCAGCG

851 CGGAAAAGCC GCCGATAAAG GACACGCCGA TGGCTTTGGC TGCCTTGTCC

901 AAAGTCTGCG CCACGCTGAC ATAA
```

This encodes a protein having amino acid sequence <SEQ ID 680>:

```
  1 MRTAVVLLLI MPMAASSAMM PEMVCAGVSP GTAIMSKPTE QTAVMASSLS

51 SVNTPASAAA IIPSSSETGI NAPLKPPTAL EAIMPPFFTA SFSNAKAAVV

101 PCVPQTLKPI SSRMRATESP TAGVGASDKS RMPNGIFSIF EASRPMSSPT

151 RVILKAVFFT TSATSVRLTA SEFSSAALTT PGPDTPTLIT ASASPEPWNA

201 PAINGLSSTA LQNTTILAQP KPSGVISAVR LMVSPASLTA SILIPARVLP

251 ILMELHTISV VFIASGTERI NTSSEGDIPF CTSAEKPPIK DTPMALAALS

301 KVCATLT*
```

ORF24ng and ORF24-1 show 96.1% identity in 307 aa overlap:

```
                       10         20         30         40         50         60
    orf24-1.pep    MRTAVVLLLIMPMAASSAMMPEMVCAGVSPGTAIISKPTEQTAVMASSLSSVSTPASAAA
                   ||||||||||||||||||||||||||||||||:|||||||||||||||||:|||||||
    orf24ng        MRTAVVLLLIMPMAASSAMMPEMVCAGVSPGTAIMSKPTEQTAVMASSLSSVNTPASAAA
                       10         20         30         40         50         60
                       70         80         90        100        110        120
    orf24-1.pep    IIPSSSETGINAPLKPPTALEAIMPPFFTASFSNAKAAVVPCVPQTLKPISSRMRATESP
                   ||||||||||||||||||||||||||||||||||||||||||||||||||||||||||||
    orf24ng        IIPSSSETGINAPLKPPTALEAIMPPFFTASFSNAKAAVVPCVPQTLKPISSRMRATESP
                       70         80         90        100        110        120
                      130        140        150        160        170        180
    orf24-1.pep    TAGVGASDKSRIPNGIFSIFEASRPMSSPTRVILKAVFFTTSATSVNVVASEFSNAAFTT
                   |||||||||:|||||||||||||||||||||||||||||||||::|||||:|:|||:||
    orf24ng        TAGVGASDKSRMPNGIFSIFEASRPMSSPTRVILKAVFFTTSATSVRLTASEFSSAALTT
                      130        140        150        160        170        180
                      190        200        210        220        230        240
    orf24-1.pep    PGPDTPTLITASASPEPXNAPAINGLSSTALQNTTILAQPKPSGVISAVRLTVSPASLTA
                   |||||||||||||||||:||||||||||||||||||||||||||||||||||:|||||
    orf24ng        PGPDTPTLITASASPEPWNAPAINGLSSTALQNTTILAQPKPSGVISAVRLMVSPASLTA
                      190        200        210        220        230        240
                      250        260        270        280        290        300
    orf24-1.pep    SILIPARVLPILMELHTISVVFIASGMERINTSSEGDIPFCTNAEKPPIKDTPMALAALS
                   |||||||||||||||||||||||||||:||||||||||||||:|||||||||||||||
    orf24ng        SILIPARVLPILMELHTISVVFIASGTERINTSSEGDIPFCTSAEKPPIKDTPMALAALS
                      250        260        270        280        290        300 orf24-1.pep    KVCATLTX
                   ||||||||
    orf24ng        KVCATLTX
```

Based on this analysis, including the presence of a putative leader sequence (first 18 aa—double-underlined) and putative transmembrane domains (single-underlined) in the gonococcal protein, it is predicted that the proteins from *N. meningitidis* and *N. gonorrhoeae*, and their epitopes, could be useful antigens for vaccines or diagnostics, or for raising antibodies.

Example 81

The following partial DNA sequence was identified in *N. meningitidis* <SEQ ID 681>:

```
  1 ..ACCGACGTGC AAAAAGAGTT GGTCGGCGAA CAACGCAAGT GGGCGCAGGA

51   AAAAATCAGC AACTGCCGAC AAGCCGCCGC GCAGGCAGAC CGGCAGGAAT

101   ACGCCGAATA CCTCAAGCTG CAATGCGACA CGCGGATGAC GCGCGAACGG

151   ATACAGTATC TTCGCGGCTA TTCCATCGAT TAG
```

This corresponds to the amino acid sequence <SEQ ID 682; ORF25>:

```
  1 ..TDVQKELVGE QRKWAQEKIS NCRQAAAQAD RQEYAEYLKL QCDTRMTRER

51   IQYLRGYSID *
```

Further work revealed the complete nucleotide sequence <SEQ ID 683>:

```
   1 ATGTATCGGA AACTCATTGC GCTGCCGTTT GCCCTGCTGC TTGCCGCTTG

51 CGGCAGGGAA GAACCGCCCA AGGCATTGGA ATGCGCCAAC CCCGCCGTGT

101 TGCAAGGCAT ACGCGGCAAT ATTCAGGAAA CGCTCACGCA GGAAGCGCGT

151 TCTTTCGCGC GCGAAGACGG CAGGCAGTTT GTCGATGCCG ACAAAATTAT

201 CGCCGCCGCC TACGGTTTGG CGTTTTCTTT GGAACACGCT TCGGAAACGC

251 AGGAAGGCGG GCGCACGTTC TGTATCGCCG ATTTGAACAT TACCGTGCCG

301 TCTGAAACGC TTGCCGATGC CAAGGCAAAC AGCCCCCTGT TGTACGGGGA

351 AACTGCTTTG TCGGATATTG TGCGGCAGAA GACGGGCGGC AATGTCGAGT

401 TTAAAGACGG CGTATTGACG GCAGCCGTCC GCTTCCTGCC CGTCAAAGAC

451 GGTCAGACGG CATTTGTCGA CAACACGGTC GGTATGGCGG CGCAAACGCT

501 GTCTGCCGCG CTGCTGCCTT ACGGCGTGAA GAGCATCGTG ATGATAGACG

551 GCAAGGCGGT GAAAAAGAA GACGCGGTCA GGATTTTGAG CGGAAAAGCC

601 CGTGAAGAAG AACCGTCCAA ACCCACGCCC GAAGACATTT TGGAACACAA

651 TGCCGCCGGC GGCGATGCGG GCGTACCCCA AGCCGCAGAA GGCGCGCCCG

701 AACCGGAAAT CCTGCATCCT GACGACGGCG AGCGTGCCGA TACCGTTACC

751 GTATCACGGG GCGAAGTGGA AGAGGCGCGC GTACAAAACC AGCGTGCGGA

801 ATCCGAAATT ACCAAACTTT GGGGAGGACT CGATACCGAC GTGCAAAAAG

851 AGTTGGTCGG CGAACAACGC AAGTGGGCGC AGGAAAAAAT CAGCAACTGC

901 CGACAAGCCG CCGCGCAGGC AGACCGGCAG GAATACGCCG AATACCTCAA

951 GCTGCAATGC GACACGCGGA TGACGCGCGA ACGGATACAG TATCTTCGCG

1001 GCTATTCCAT CGATTAG
```

This corresponds to the amino acid sequence <SEQ ID 684; ORF25-1>:

```
  1 MYRKLIALPF ALLLAACGRE EPPKALECAN PAVLQGIRGN IQETLTQEAR

51 SFAREDGRQF VDADKIIAAA YGLAFSLEHA SETQEGGRTF CIADLNITVP

101 SETLADAKAN SPLLYGETAL SDIVRQKTGG NVEFKDGVLT AAVRFLPVKD

151 GQTAFVDNTV GMAAQTLSAA LLPYGVKSIV MIDGKAVKKE DAVRILSGKA

201 REEEPSKPTP EDILEHNAAG GDAGVPQAAE GAPEPEILHP DDGERADTVT

251 VSRGEVEEAR VQNQRAESEI TKLWGGLDTD VQKELVGEQR KWAQEKISNC

301 RQAAAQADRQ EYAEYLKLQC DTRMTRERIQ YLRGYSID*
```

Computer analysis of this amino acid sequence gave the following results:

Homology with a Predicted ORF from *N. meningitidis* (Strain A)

ORF25 shows 98.3% identity over a 60aa overlap with an ORF (ORF25a) from strain A of *N. meningitidis*:

```
                                          10        20        30
   orf25.pep                        TDVQKELVGEQRKWAQEKISNCRQAAAQAD
                                    ||||||||||||| |||||||||||||||
   orf25a      VTVSRGEVEEARVQNQRAESEITKLWGGLDTDVQKELVGEXRKWAQEKISNCRQAAAQAD
               250       260       270       280       290       300

40        50        60
   orf25.pep   RQEYAEYLKLQCDTRMTRERIQYLRGYSIDX
               ||||||||||||||||||||||||||||||
   orf25a      RQEYAEYLKLQCDTRMTRERIQYLRGYSIDX
               310       320       330
```

The complete length ORF25a nucleotide sequence <SEQ ID 685> is:

```
   1 ATGTATCGGA AACTCATTGC GCTGCCGTTT GCCCTGCTGC TTGCCGCTTG

51 CGGCAGGGAA GAACCGCCCA AGGCATTGGA ATGCGCCAAC CCCGCCGTGT

101 TGCAANGCAT ACGCNGCAAT ATTCAGGAAA CGCTCACGCA GGAAGCGCGT

151 TCTTTCGCGC GCGAAGACNG CANGCAGTTT GTCGATGCCG ACNAAATTAT

201 CGCCGCCGCC TANGNTNNGN NGNTNTCTTT GGAACACGCT TCGGAAACGC

251 AGGAAGGCGG GCGCACGTTC TGTNTCGCCG ATTTGAACAT TACCGTGCCG

301 TCTGAAACGC TTGCCGATGC CAAGGCAAAC AGCCCCCTGC TGTACGGGGA

351 AACCGCTTTG TCGGATATTG TGCGGCAGAA GACGGGCGGC AATGTCGAGT

401 TTAAAGACGG CGTATTGACG GCAGCCGTCC GCTTCCTACC CGTCAAAGAC

451 GGTCAGANGG CATTTGTCGA CAACACGGTC GGTATGGCGG CGCAAACGCT

501 GTCTGCCGCG TTGCTGCCTT ACGGCGTGAA GAGCATCGTG ATGATAGACG

551 GCAAGGCGGT AAAAAAAGAA GACGCGGTCA GGATTNTGAG CNGANAAGCC

601 CGTGAANAAG AACCGTCCAA ANCCNNGCCC GAAGACATTT TGGAACATAA

651 TGCCGCCGGA GGGGATGCAG ACGTACCCCA AGCCGGAGAA GACGCGCCCG

701 AACCGGAAAT CCTGCATCCT GACGACGGCG AGCGTGCCGA TACCGTTACC

751 GTATCACGGG GCGAAGTGGA AGAGGCGCGN GTACAAAACC AGCGTGCGGA

801 ATCCGAAATT ACCAAACTTT GGGGAGGACT CGATACCGAC GTGCAAAAAG

851 AGTTGGTCGG CGAANAACGC AAGTGGGCGC AGGAAAAAAT CAGCAACTGC

901 CGACAAGCCG CCGCGCAGGC AGACCGGCAG GAATACGCCG AATACCTCAA

951 GCTGCAATGC GACACGCGGA TGACGCGCGA ACGGATACAG TATCTTCGCG

1001 GCTATTCCAT CGATTAG
```

This encodes a protein having amino acid sequence <SEQ ID 686>:

```
  1 MYRKLIALPF ALLLAACGRE EPPKALECAN PAVLQXIRXN IQETLTQEAR

51 SFAREDXXQF VDADXIIAAA XXXXXSLEHA SETQEGGRTF CXADLNITVP
```

-continued

```
101 SETLADAKAN SPLLYGETAL SDIVRQKTGG NVEFKDGVLT AAVRFLPVKD

151 GQXAFVDNTV GMAAQTLSAA LLPYGVKSIV MIDGKAVKKE DAVRIXSXXA

201 REXEPSKXXP EDILEHNAAG GDADVPQAGE DAPEPEILHP DDGERADTVT

251 VSRGEVEEAR VQNQRAESEI TKLWGGLDTD VQKELVGEXR KWAQEKISNC

301 RQAAAQADRQ EYAEYLKLQC DTRMTRERIQ YLRGYSID*
```

ORF25a and ORF25-1 show 93.5% identity in 338 aa overlap:

```
                       10         20         30         40         50         60
        orf25a.pep  MYRKLIALPFALLLAACGREEPPKALECANPAVLQXIRXNIQETLTQEARSFAREDXXQF
                    ||||||||||||||||||||||||||||||||||| || |||||||||||||||||  |
        orf25-1     MYRKLIALPFALLLAACGREEPPKALECANPAVLQGIRGNIQETLTQEARSFAREDGRQF
                       10         20         30         40         50         60
                       70         80         90        100        110        120
        orf25a.pep  VDADXIIAAAXXXXXSLEHASETQEGGRTFCXADLNITVPSETLADAKANSPLLYGETAL
                    |||| ||||      |||||||||||||||| ||||||||||||||||||||||||||||
        orf25-1     VDADKIIAAAYGLAFSLEHASETQEGGRTFCIADLNITVPSETLADAKANSPLLYGETAL
                       70         80         90        100        110        120
                      130        140        150        160        170        180
        orf25a.pep  SDIVRQKTGGNVEFKDGVLTAAVRFLPVKDGQXAFVDNTVGMAAQTLSAALLPYGVKSIV
                    ||||||||||||||||||||||||||||||| :||||||||||||||||||||||||||
        orf25-1     SDIVRQKTGGNVEFKDGVLTAAVRFLPVKDGQTAFVDNTVGMAAQTLSAALLPYGVKSIV
                      130        140        150        160        170        180
                      190        200        210        220        230        240
        orf25a.pep  MIDGKAVKKEDAVRIXSXXAREXEPSKXXPEDILEHNAAGGDADVPQAGEDAPEPEILHP
                    ||||||||||||||| | || |||||  :||||||||||||| : |||:|||||||||||
        orf25-1     MIDGKAVKKEDAVRILSGKAREEEPSKPTPEDILEHNAAGGDAGVPQAAEGAPEPEILHP
                      190        200        210        220        230        240
                      250        260        270        280        290        300
        orf25a.pep  DDGERADTVTVSRGEVEEARVQNQRAESEITKLWGGLDTDVQKELVGEXRKWAQEKISNC
                    ||||||||||||||||||||||||||||||||||||||||||||||||| ||||||||||
        orf25-1     DDGERADTVTVSRGEVEEARVQNQRAESEITKLWGGLDTDVQKELVGEQRKWAQEKISNC
                      250        260        270        280        290        300
                      310        320        330        339
        orf25a.pep  RQAAAQADRQEYAEYLKLQCDTRMTRERIQYLRGYSIDX
                    |||||||||||||||||||||||||||||||||||||||
        orf25-1     RQAAAQADRQEYAEYLKLQCDTRMTRERIQYLRGYSIDX
                      310        320        330
```

Homology with a Predicted ORF from *N. gonorrhoeae*

ORF25 shows 100% identity over a 60aa overlap with a predicted ORF (ORF25ng) from *N. gonorrhoeae*:

```
        orf25.pep                      TDVQKELVGEQRKWAQEKISNCRQAAAQAD   30
                                       ||||||||||||||||||||||||||||||
        orf25ng     VTVSRGEVEEARVQNQRAESEITKLWGGLDTDVQKELVGEQRKWAQEKISNCRQAAAQAD  308 orf25.pep   RQEYAEYLKLQCDTRMTRERIQYLRGYSID   60
                    ||||||||||||||||||||||||||||||
        orf25ng     RQEYAEYLKLQCDTRMTRERIQYLRGYSID  338
```

The complete length ORF25ng nucleotide sequence <SEQ ID 687> is:

```
  1 ATGTATCGGA AACTCATTGC GCTGCCGTTT GCCCTGCTGC TTGCAGCGTG

51 CGGCAGGGAA GAACCGCCCA AGGCGTTGGA ATGCGCCAAC CCCGCCGTGT

101 TGCAGGACAT ACGCGGCAGT ATTCAGGAAA CGCTCACGCA GGAAGCGCGT

151 TCTTTCGCGC GCGAAGACGG CAGGCAGTTT GTCGATGCCG ACAAAATTAT
```

-continued

```
201 CGCCGCCGCC TACGGTTTGG CGTTTTCTTT GGAACACGCT TCGGAAACGC

251 AGGAAGGCGG GCGCACGTTC TGTATCGCCG ATTTGAACAT TACCGTGCCG

301 TCTGAAACGC TTGCCGATGC CGAGGCAAAC AGCCCCCTGC TGTATGGGGA

351 AACGTCTTTG GCAGACATCG TGCAGCAGAA GACGGGCGGC AATGTCGAGT

401 TTAAAGACGG CGTATTGACG GCAGCCGTCC GCTTCCTGCC CGCCAAAGAC

451 GCTCGGACGG CATTTATCGA CAACACGGTC GGTATGGCGA CGCAAACGCT

501 GTCTGCCGCG TTGCTGCCTT ACGGCGTGAA GAGCATCGTG ATGATAGACG

551 GCAAGGCGGT GACAAAAGAA GACGCGGTCA GGGTTTTGAG CGGCAAAGCC

601 CGTGAAGAAG AACCGTCCAA ACCCACCCCC GAAGACATTT TGGAACACAA

651 TGCCGCCGGC GGCGATGCGG GCGTACCCCA AGCCGCAGAA GGCGCACCCG

701 AACCCGAAAT CCTGCATCCC GACGACGTCG AGCGTGCCGA TACCGTTACC

751 GTATCACGGG GCGAAGTGGA AGAGGCGCGC GTACAAAACC AACGTGCGGA

801 ATCCGAAATT ACCAAACTTT GGGGAGGACT CGATACCGAC GTGCAAAAAG

851 AGTTGGTCGG CGAACAGCGC AAGTGGGCGC AGGAAAAAAT CAGcaactgc 901 cgACAAGCCG CCGCGCAGGC AGACCGGCAG GAATACGCCG AATACCTCAA 951 GCTCCAATGC GACACGCGGA TGACGCGCGA ACggaTACAG TATCTTCGCG

1001 GCTATTCCAT CGATTAG
```

This encodes a protein having amino acid sequence <SEQ ID 688>:

```
  1 MYRKLIALPF ALLLAACGRE EPPKALECAN PAVLQDIRGS IQETLTQEAR

51 SFAREDGRQF VDADKIIAAA YGLAFSLEHA SETQEGGRTF CIADLNITVP

101 SETLADAEAN SPLLYGETSL ADIVQQKTGG NVEFKDGVLT AAVRFLPAKD

151 ARTAFIDNTV GMATQTLSAA LLPYGVKSIV MIDGKAVTKE DAVRVLSGKA

201 REEEPSKPTP EDILEHNAAG GDAGVPQAAE GAPEPEILHP DDVERADTVT

251 VSRGEVEEAR VQNQRAESEI TKLWGGLDTD VQKELVGEQR KWAQEKISNC

301 RQAAAQADRQ EYAEYLKLQC DTRMTRERIQ YLRGYSID*
```

ORF25ng and ORF25-1 show 95.9% identity in 338 aa overlap:

```
                   10         20         30         40         50         60
      orf25-1.pep  MYRKLIALPFALLLAACGREEPPKALECANPAVLQGIRGNIQETLTQEARSFAREDGRQF
                   ||||||||||||||||||||||||||||||||||| ||:||||||||||||||||||||||
      orf25ng      MYRKLIALPFALLLAACGREEPPKALECANPAVLQDIRGSIQETLTQEARSFAREDGRQF
                   10         20         30         40         50         60

70         80         90        100        110        120
      orf25-1.pep  VDADKIIAAAYGLAFSLEHASETQEGGRTFCIADLNITVPSETLADAKANSPLLYGETAL
                   ||||||||||||||||||||||||||||||||||||||||||||||:|||||||||||:|
      orf25ng      VDADKIIAAAYGLAFSLEHASETQEGGRTFCIADLNITVPSETLADAEANSPLLYGETSL
                   70         80         90        100        110        120
```

```
                    130         140        150          160         170        180
orf25-1.pep   SDIVRQKTGGNVEFKDGVLTAAVRFLPVKDGQTAFVDNTVGMAAQTLSAALLPYGVKSIV
              :|||:||||||||||||||||||||||:||::|||:||||||:||||||||||||||||
orf25ng       ADIVQQKTGGNVEFKDGVLTAAVRFLPAKDARTAFIDNTVGMATQTLSAALLPYGVKSIV
                    130         140        150          160         170        180

190         200        210          220         230        240
orf25-1.pep   MIDGKAVKKEDAVRILSGKAREEEPSKPTPEDILEHNAAGGDAGVPQAAEGAPEPEILHP
              |||||||  ||||| :||||||||||||||||||||||||||||||||||||||||||||
orf25ng       MIDGKAVTKEDAVRVLSGKAREEEPSKPTPEDILEHNAAGGDAGVPQAAEGAPEPEILHP
                    190         200        210          220         230        240

250         260        270          280         290        300
orf25-1.pep   DDGERADTVTVSRGEVEEARVQNQRAESEITKLWGGLDTDVQKELVGEQRKWAQEKISNC
              ||  ||||||||||||||||||||||||||||||||||||||||||||||||||||||||
orf25ng       DDVERADTVTVSRGEVEEARVQNQRAESEITKLWGGLDTDVQKELVGEQRKWAQEKISNC
                    250         260        270          280         290        300

310         320        330          339
orf25-1.pep   RQAAAQADRQEYAEYLKLQCDTRMTRERIQYLRGYSIDX
              |||||||||||||||||||||||||||||||||||||||
orf25ng       RQAAAQADRQEYAEYLKLQCDTRMTRERIQYLRGYSIDX
                    310         320        330
```

Based on this analysis, including the presence of a predicted prokaryotic membrane lipoprotein lipid attachment site (underlined) in the gonococcal protein, it was predicted that the proteins from *N. meningitidis* and *N. gonorrhoeae*, and their epitopes, could be useful antigens for vaccines or diagnostics, or for raising antibodies.

ORF25-1 (37 kDa) was cloned in pET and pGex vectors and expressed in *E. coli*, as described above. The products of protein expression and purification were analyzed by SDS-PAGE. FIG. 16A shows the results of affinity purification of the GST-fusion protein, and FIG. 16B shows the results of expression of the His-fusion in *E. coli*. Purified His-fusion protein was used to immunise mice, whose sera were used for Western blot (FIG. 16C), ELISA (positive result), and FACS analysis (FIG. 16D). These experiments confirm that ORF25-1 is a surface-exposed protein, and that it is a useful immunogen.

Figure 16E:
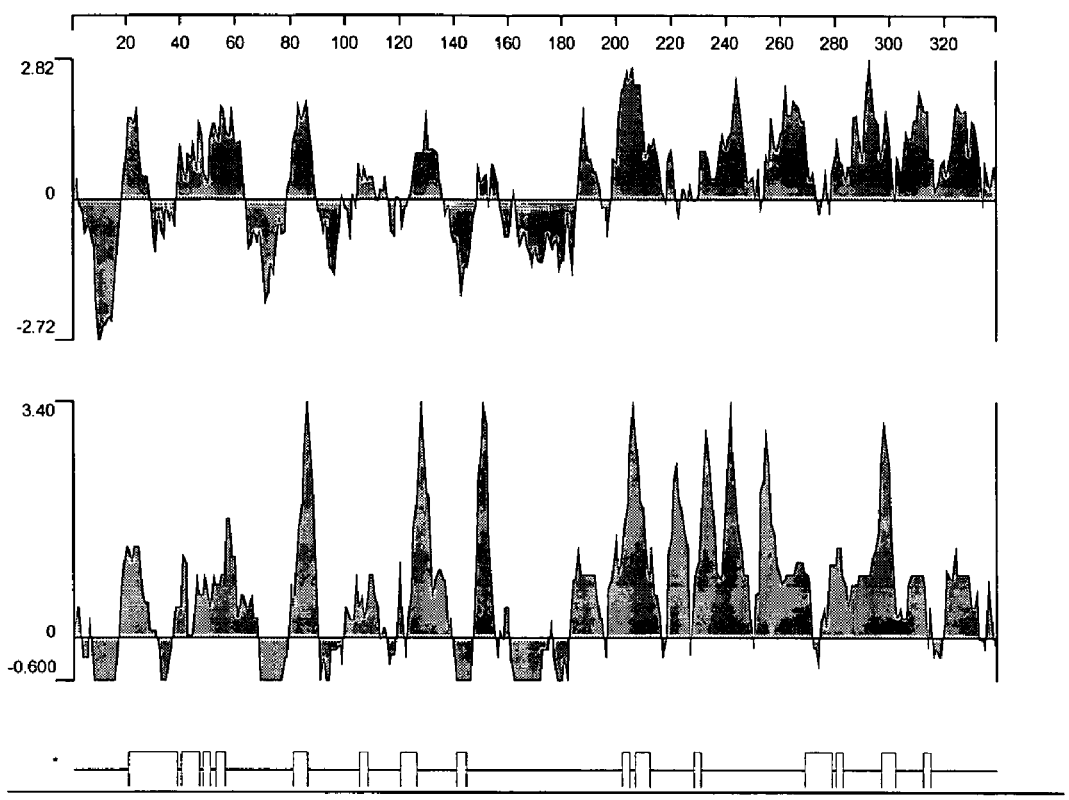

FIG. 16E shows plots of hydrophilicity, antigenic index, and AMPHI regions for ORF25-1.

Example 82

The following partial DNA sequence was identified in *N. meningitidis* <SEQ ID 689>

```
   1 ATGCAGCTGA TCGACTATTC ACATTCATTT TTCTCGGTTG
     TGCCACCCTT

51 TTTGGCACTG GCACTTGCCG TCATTACCCG CCGCGTACTG
     CTGTCTTTAG

101 GCATCGGTAT TCTGGwysGC GTTGCCTTTT TGGTCGGCGG
     CAACCCCGTC

151 GACGGTCTGA CACACCTGAA AGACATGGTC GTCGGCTTGG
     CTTGGTCAGA

201 CGsyGATTGG TCGCTGGGCA AACCAAAAAT CTTGGTTTTC
     CkGATACTTT

251 TGGGTATTTT TACTTCCCTG CTGACCTACT CCGGCAGCAA
     T.........

851 .......... .......... .......... ........AC
     TTCGCTGGTA

901 TTCGGCGGCA CTTGCCGCGT CTTTGCCGTC GTTCTCTGCA
     CGCTCGGCAC

951 GATTAAAACC GCCGACTATC CCAAAGCCGT TTGGCAGGGT
     GCGAAATCTA

1001 TGTTCGGCGC AATCGCCATT TTAATCCTCG CTTGGCTCAT
     CAGTACGGTT

1051 GTCGGCGAAA TGCACACCGG CGATTACCTC TCCACACTGG
     TTGCGGGCAA

1101 CATCCATCCC GGCTTCCTCC CCGTCATCCT CTTCCTGCTC
     GCCAGCGTGA

1151 TGGCGTTTGC CACAGGCACA AGCTGGGGGA CGTTCGGCAT
     TATGCTGCCG

1201 ATTGCCGCCG CCATGGCGGT CAAAGTCGAA CCCGCGCTGA
     TTATCCCGTG

1251 TATCTCCGCA GTAATGGCGG GGGCGGTATG CGGCGACCAC
     TGCTCGCCCA

1301 TTTCCGACAC GACCATCCTG TCGTCCACCG GCGCGCGCTG
     CAACCACATC

1351 GACCACGTTA CCTCGCAACT GCCTTACGCC TTAACCGTTG
     CCGCCGCCGC

1401 CGCATCGGGC TACCTCGCAT GGGTCTGAC AAAATCCGCG
     CTGTTGGGCT

1451 TTGGCACGAC AGGCATTGTA TTGGCGGTGC TGATTTTTCT
     GTTGAAAGAT

1501 AAAAAA...
```

This corresponds to the amino acid sequence <SEQ ID 690; ORF26>:

```
  1 MQLIDYSHSF FSVVPPFLAL ALAVITRRVL LSLGIGILXX
    VAFLVGGNPV

51 DGLTHLKDMV VGLAWSDXDW SLGKPKILVF XILLGIFTSL
    LTYSGSN...

//

251 .......... .......... .......... ..........
    ......TSLV

301 FGGTCGVFAV VLCTLGTIKT ADYPKAVWQG AKSMFGAIAI
    LILAWLISTV

351 VGEMHTGDYL STLVAGNIHP GFLPVILFLL ASVMAFATGT
    SWGTFGIMLP

401 IAAAMAVKVE PALIIPCMSA VMAGAVCGDH CSPISDTTIL
    SSTGARCNHI

451 DHVTSQLPYA LTVAAAAASG YLALGLTKSA LLGFGTTGIV
    LAVLIFLLKD

501 KK...
```

Further work revealed the complete nucleotide sequence <SEQ ID 691>:

```
   1 ATGCAGCTGA TCGACTATTC ACATTCATTT TTCTCGGTTG
     TGCCACCCTT

51 TTTGGCACTG GCACTTGCCG TCATTACCCG CCGCGTACTG
     CTGTCTTTAG

101 GCATCGGTAT TCTGGTCGGC GTTGCCTTTT TGGTCGGCGG
     CAACCCCGTC

151 GACGGTCTGA CACACCTGAA AGACATGGTC GTCGGCTTGG
     CTTGGTCAGA

201 CGGCGATTGG TCGCTGGGCA AACCAAAAAT CTTGGTTTTC
     CTGATACTTT

251 TGGGTATTTT TACTTCCCTG CTGACCTACT CCGGCAGCAA
     TCAGGCGTTT

301 GCCGACTGGG CAAAACGGCA CATTAAAAAC CGGCGCGGCG
     CGAAAATGCT

351 GACCGCCTGC CTCGTGTTCG TAACCTTTAT CGACGACTAT
     TTCCACAGTC

401 TCGCCGTCGG TGCGATTGCC CGCCCCGTTA CCGACAAGTT
     TAAAGTTTCC

451 CGCACCAAAC TCGCCTACAT CCTCGACTCC ACTGCCGCTC
     CTATGTGCGT

501 GCTGATGCCC GTTTCAAGCT GGGGCGCGTC GATTATCGCC
     ACGCTTGCCG

551 GACTGCTCGT TACCTACAAA ATCACCGAAT ACACGCCGAT
     GGGGACGTTT

601 GTCGCCATGA GCCTGATGAA CTATTACGCA CTGTTTGCCC
     TGATTATGGT

651 GTTCGTCGTC GCATGGTTTT CCTTCGACAT CGGCTCGATG
     GCACGTTTCG

701 AACAAGCCGC GTTGAACGAA GCCCACGATG AAACTGCCGT
     TTCAGACGCT

751 ACCAAAGGTC GTGTTTACGC ACTGATTATT CCCGTTTTGG
     CCTTAATCGC

801 CTCAACGGTT TCCGCCATGA TCTACACCGG CGCGCAGGCA
     AGCGAAACCT

851 TCAGCATTTT GGGGGCATTT GAAAACACGG ACGTAAACAC
     TTCGCTGGTA

901 TTCGGCGGCA CTTGCGGCGT CCTTGCCGTC GTTCTCTGCA
     CGCTCGGCAC

951 GATTAAAACC GCCGACTATC CCAAAGCCGT TTGGCAGGGT
     GCGAAATCTA

1001 TGTTCGGCGC AATCGCCATT TTAATCCTCG CTTGGCTCAT
     CAGTACGGTT

1051 GTCGGCGAAA TGCACACCGG CGATTACCTC TCCACACTGG
     TTGCGGGCAA

1101 CATCCATCCC GGCTTCCTGC CCGTCATCCT CTTCCTGCTC
     GCCAGCGTGA

1151 TGGCGTTTGC CACAGGCACA AGCTGGGGGA CGTTCGGCAT
     TATGCTGCCG

1201 ATTGCCGCCG CCATGGCGGT CAAAGTCGAA CCCGCGCTGA
     TTATCCCGTG

1251 TATGTCCGCA GTAATGGCGG GGCGGTATG CGGCGACCAC
     TGCTCGCCCA

1301 TTTCCGACAC GACCATCCTG TCGTCCACCG GCGCGCGCTG
     CAACCACATC

1351 GACCACGTTA CCTCGCAACT GCCTTACGCC TTAACCGTTG
     CCGCCGCCGC

1401 CGCATCGGGC TACCTCGCAT TGGGTCTGAC AAAATCCGCG
     CTGTTGGGCT

1451 TTGGCACGAC AGGCATTGTA TTGGCGGTGC TGATTTTTCT
     GTTGAAAGAT

1501 AAAAAACGCG CCAACGCCTG A
```

This corresponds to the amino acid sequence <SEQ ID 692; ORF26-1>:

```
  1 MQLIDYSHSF FSVVPPFLAL ALAVITRRVL LSLGIGILVG
    VAFLVGGNPV

51 DGLTHLKDMV VGLAWSDGDW SLGKPKILVF LILLGIFTSL
    LTYSGSNQAF

101 ADWAKRHIKN RRGAKMLTAC LVFVTFIDDY FHSLAVGAIA
    RPVTDKFKVS

151 RTKLAYILDS TAAPMCVLMP VSSWGASIIA TLAGLLVTYK
    ITEYTPMGTF

201 VAMSLMNYYA LFALIMVFVV AWFSFDIGSM ARFEQAALNE
    AHDETAVSDA

251 TKGRVYALII PVLALIASTV SAMIYTGAQA SETFSILGAF
    ENTDVNTSLV

301 FGGTCGVLAV VLCTLGTIKT ADYPKAVWQG AKSMFGAIAI
    LILAWLISTV

351 VGEMHTGDYL STLVAGNIHP GFLPVILFLL ASVMAFATGT
    SWGTFGIMLP

401 IAAAMAVKVE PALIIPCMSA VMAGAVCGDH CSPISDTTIL
    SSTGARCNHI

451 DHVTSQLPYA LTVAAAAASG YLALGLTKSA LLGFGTTGIV
    LAVLIFLLKD

501 KKRANA*
```

Computer analysis of this amino acid sequence gave the following results:

Homology with the Hypothetical Transmembrane Protein HI1586 of *H. influenzae* (Accession Number P44263)

ORF26 and HI1586 show 53% and 49% amino acid identity in 97 and 221 aa overlap at the N-terminus and C-terminus, respectively:

```
Orf26    1 MQLIDYSHSFFSVVPPFLALALAVITRRVXXXXXXXXXXXXVAFLVGGNPVDGLTHLKDMV    60
           M+LID+S S +S+VP  LA+ LA+ TRRV              L        +L  V
HI1586  14 MELIDFSSSVWSIVPALLAIILAIATRRVLVSLSAGIIIGSLMLSDWQIGSAFNYLVKNV   73

Orf26   61 VGLAWSDXDWSLGKPKILVFXILLGIFTSLLTYSGSN                          97
           V L ++D + +    I++F +LLG+ T+LLT SGSN
HI1586  74 VSLVYADGEIN-SNMNIVLFLLLLGVLTALLTVSGSN                         109

//

Orf26   86 IFTSLLTYSCS--NTSLVFGGTCGVFAVVLCTL--CTIKTADYPKAVWQGAKSMFGXXXX  141
           +F+ L T+ +    TSLV GG C +   L  +    +Y ++   G KSM G
HI1586 299 VFSVLGTFENTVVGTSLVVGGFCSIIISTLLIILDRQVSVPEYVRSWIVGIKSMSGAIAI  358

Orf26  142 XXXXXXXSTVVGEMHTGDYLSTLVAGNIHPGFLPVILFLLASVMAFATGTSWGTFGIMLP  201
              + +VG+M TG YLS+LV+GNI    FLPVILF+L + MAF+TGTSWGTFGIMLP
HI1586 359 LFFAWTINKIVGDMQTGKYLSSLVSGNIPMQFLPVILFVLGAAMAFSTGTSWGTFGIMLP  418

Orf26  202 IAAAMAVKVEPALIIPCMSAVMAGAVCGDHCSPISDTTILSSTGARCNHIDHVTSQXXXX  261
           IAAAMA    P L++PC+SAVMAGAVCGDHCSP+SDTTILSSTGA+CNHIDHVT+Q
HI1586 419 IAAAMAANAAPELLLPCLSAVMAGAVCGDHCSPVSDTTILSSTGAKCNHIDHVTTQLPYA  478

Orf26  262 XXXXXXXXXXXXXXXXXKSALLGFGTTGIVLAVLIFLLKDK                     302
                             S L GF  T + L V+IF +K +
HI1586 479 ATVATATSIGYIVVGFTYSGLAGFAATAVSLIVIIFAVKKR                     519
```

Homology with a Predicted ORF from *N. meningitidis* (Strain A)

ORF26 shows 58.2% identity over a 502aa overlap with an ORF (ORF26a) from strain A of *N. meningitidis*:

```
                   10        20        30        40        50        60
orf26.pep  MQLIDYSHSFFSVVPPFLALALAVITRRVLLSLGIGILXXVAFLVGGNPVDGLTHLKDMV
           |||||||||||||||||||||||||||||||||||||||  |||||||||||||||||||
orf26a     MQLIDYSHSFFSVVPPFLALALAVITRRVLLSLGIGILVGVAFLVGGNPVDGLTHLKDMV
                   10        20        30        40        50        60

70        80        90        99
orf26.pep  VGLAWSDXDWSLGKPKILVFXILLGIFTSLLTYSGSNXX---------------------
           |||||||  ||||||| ||||  |||||||||||||||
orf26a     VGLAWSDGDWSLGKPKXLVFLILLGIFTSLLTYSGSNQAFADWAKRHIKNRRGAKMLTAC
                   70        80        90       100       110       120 orf26.pep  ------------------------------------------------------------ orf26a     LVFVTFIDDYFHSLAVGAXARPVTDKFKVSRAKLAYILDSTAAPMCVLMPVSSWGASIIA
                  130       140       150       160       170       180 orf26.pep  ------------------------------------------------------------ orf26a     TLAGLLVTYKITEYTPMGTFVAMSLMNYYALFALIMVFVVAWFSFDIGSMARFEQAALNE
                  190       200       210       220       230       240

100       110
orf26.pep  -----------------------------------------------------------TSLV
                                                                              ||||
orf26a     AHDETAVSDGSWGRVYALIIPVLALIASTVSAMIYTGAQASETESILGAFENTDVNTSLV
                  250       260       270       280       290       300
```

```
                      -continued
         120       130       140       150       160       170
orf26.pep FGGTCGVFAVVLCTLGTIKTADYPKAVWQGAKSMFGAIAILILAWLISTVVGEMHTGDYL
          ||||||:||||||||||| |||||||||||||||||||||||||||||||||||||||
orf26a    FGGTCGVLAVVLCTLGTIKIADYPKAVWQGAKSMFGAIAILILAWLISTVVGEMHTGDYL
         310       320       330       340       350       360

180       190       200       210       220       230
orf26.pep STLVAGNIHPGFLPVILFLLASVMAFATGTSWGTFGIMLPIAAAMAVKVEPALIIPCMSA
          |||||||||||||:|||||||||||||||||||||||||||||||||||:|||||||||
orf26a    STLVAGNIHPGFLXVILFLLASVMAFATGTSWGTFGIMLPIAAAMAVKVDPSLIIPCMSA
         370       380       390       400       410       420

240       250       260       270       280       290
orf26.pep VMAGAVCGDHCSPISDTTILSSTGARCNHIDHVTSQLPYALTVAAAASGYLALGLTKSA
          |||||||||
orf26a    VMAGAVCGDHCSPISDTTILSSTGARCNHIDHVTSQLPYALTVAAAASGYLALGLTKSA
         430       440       450       460       470       480

300       310
orf26.pep LLGFGTTGIVLAVLIFLLKDKK
          |||||:||||||||||||||||
orf26a    LLGFGXTGIVLAVLIFLLKDKKRANAX
         490       500
```

The complete length ORF26a nucleotide sequence <SEQ ID 693> is:

```
   1 ATGCAGCTGA TCGACTATTC ACATTCATTT TTCTCGGTTG
     TGCCACCCTT
  51 TTTGGCACTG GCACTTGCCG TCATTACCCG CCGCGTACTG
     CTGTCTTTAG
 101 GCATCGGTAT TCTGGTCGCC GTTGCCTTTT TGGTCGGCGG
     CAACCCCGTC
 151 GACGGTCTGA CACACCTGAA ACACATGGTC GTCGGCTTGG
     CTTGGTCAGA
 201 CGGCGATTGG TCGCTGGGCA AACCAAAANT CTTGGTTTTC
     CTGATACTTT
 251 TGGGTATTTT TACTTCCCTG CTGACCTACT CCGGCAGCAA
     TCAGGCGTTT
 301 GCCGACTGGG CAAAACGGCA CATTAAAAAC CGGCGCGGCG
     CGAAAATGCT
 351 GACCGCCTGC CTCGTGTTCG TAACCTTTAT CGACGACTAT
     TTCCACAGTC
 401 TCGCCGTCGG TGCGNTTGCC CGCCCCGTTA CCGACAAGTT
     TAAAGTTTCC
 451 CGCGCCAAAC TCGCCTACAT CCTCGACTCC ACTGCCGCGC
     CTATGTGCGT
 501 GCTGATGCCC GTTTCAAGCT GGGGCGCGTC GATTATCGCC
     ACGCTTGCCG
 551 GACTGCTCGT TACCTACAAA ATCACCGAAT ACACGCCGAT
     GGGGACGTTT
 601 GTCGCCATGA GCCTGATGAA CTATTACGCA CTGTTTGCCC
     TGATTATGGT
 651 GTTCGTCGTC GCATGGTTCT CCTTCGACAT CGGCTCGATG
     GCACGTTTCG
 701 AACAAGCCGC GTTGAACGAA GCCCACGATG AAACTGCCGT
     TTCAGACGGC
 751 AGCTGGGGCA GGGTTTACGC ATTGATTATT CCCGTTTTGG
     CCTTAATCGC
 801 CTCAACGGTT TCCGCCATGA TCTACACCGG TGCACAGGCA
     AGCGAAACCT
 851 TCAGCATTTT GGGTGCATTT GAAAATACGG ACGTGAACAC
     TTCGCTGGTA
 901 TTCGGCGGCA CTTGCGGCGT GCTTGCCGTC GTCCTCTGCA
     CGCTCGGCAC
 951 GATTAAAATC GCCGATTATC CCAAAGCCGT TTGGCAGGGT
     GCGAAATCCA
1001 TGTTCGGCGC AATCGCCATT TTAATCCTTG CCTGGCTCAT
     CAGTACGGTT
1051 GTCGGCGAAA TGCACACAGG CGACTACCTC TCCACGCTGG
     TTGCGGGCAA
1101 CATCCATCCC GGCTTCCTGN CCGTCATCCT TTTCCTGCTC
     GCCAGCGTGA
1151 TGGCGTTTGC CACAGGCACA AGCTGGGGGA CGTTCGGCAT
     CATGCTGCCG
1201 ATTGCCGCCG CCATGGCGGT CAAAGTCGAT CCCTCACTGA
     TTATCCCGTG
1251 TATGTCCGCC GTGATGGCGG GGCGGTATG CGGCGACCAC
     TGCTCGCCCA
1301 TTTCCGACAC GACCATCCTG TCGTCCACCG GCGCGCGCTG
     CAACCACATC
1351 GACCACGTTA CNTCGCAACT GCCTTACGCC TTAACCGTTG
     CCGCCGCCGC
1401 CGCATCGGGN TACCTCCCAT TGGGTCTGAC AAAATCCGCG
     CTGTTGGGTT
```

-continued

```
1451 TTGGCANGAC AGGCATTGTA TTGGCGGTGC TGATTTTTCT
     GTTGAAAGAT

1501 AAAAAACGCG CCAACGCCTG A
```

This encodes a protein having amino acid sequence <SEQ ID 694>:

```
  1 MQLIDYSHSF FSVVPPFLAL ALAVITRRVL LSLGIGILVG
    VAFLVGGNPV

51 DGLTHLKDMV VGLAWSDGDW SLGKPKXLVF LILLGIFTSL
    LTYSGSNQAF

101 ADWAKRHIKN RRGAKMLTAC LVFVTFIDDY FHSLAVGAXA
    RPVTDKFKVS

151 RAKLAYILDS TAAPMCVLMP VSSWGASIIA TLAGLLVTYK
    ITEYTPMGTF

201 VAMSLMNYYA LFALIMVFVV AWFSFDIGSM ARFEQAALNE
    AHDETAVSDG
```

-continued

```
251 SWGRVYALII PVLALIASTV SAMIYTGAQA SETFSILGAF
    ENTDVNTSLV

301 FGGTCGVLAV VLCTLGTIKI ADYPKAVWQG AKSMFGAIAI
    LILAWLISTV

351 VGEMHTGDYL STLVAGNIHP GFLXVILFLL ASVMAFATGT
    SWGTFGIMLP

401 IAAAMAVKVD PSLIIPCMSA VMAGAVCGDH CSPISDTTIL
    SSTGARCNHI

451 DHVTSQLPYA LTVAAAAASG YLALGLTKSA LLGFGXTGIV
    LAVLIFLLKD

501 KKRANA*
```

ORF26a and ORF26-1 show 97.8% identity in 506 aa overlap:

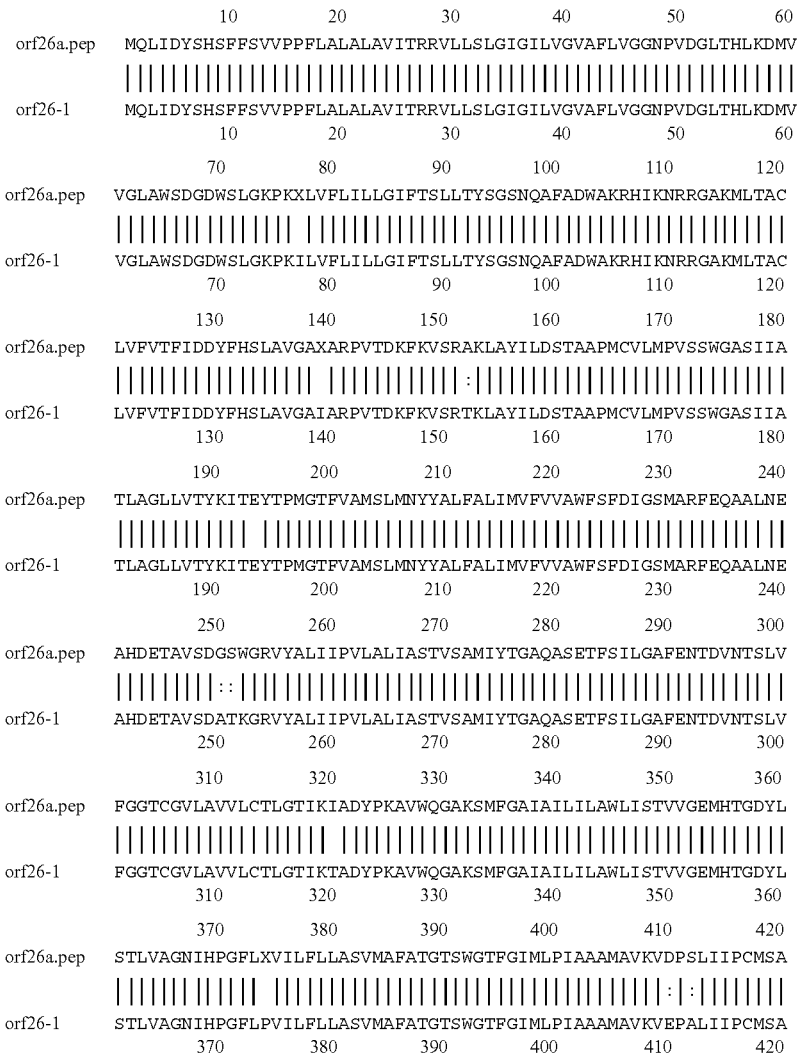

```
             430       440       450       460       470       480
orf26a.pep   VMAGAVCGDHCSPISDTTILSSTGARCNHIDHVTSQLPYALTVAAAAASGYLALGLTKSA
             ||||||||||||||||||||||||||||||||||||||||||||||||||||||||||||
orf26-1      VMAGAVCGDHCSPISDTTILSSTGARCNHIDHVTSQLPYALTVAAAAASGYLALGLTKSA
             430       440       450       460       470       480
             490       500
orf26a.pep   LLGFGXTGIVLAVLIFLLKDKKRANAX
             ||||| :||||||||||||||||||||
orf26-1      LLGFGTTGIVLAVLIFLLKDKKRANAX
             490       500
```

Homology with a Predicted ORF from *N. gonorrhoeae*

ORF26 shows 94.8% and 99% identity in 97 and 206 aa overlap at the N-terminus and C-terminus, respectively, with a predicted ORF (ORF26ng) from *N. gonorrhoeae*:

```
orf26.pep    MQLIDYSHSFFSVVPPFLALALAVITRRVLLSLGIGILXXVAFLVGGNPVDGLTHLKDMV   60
             ||||||||||||||||||||||||||||||||||||   |||||||||||||||||||||
orf26ng      MQLIDYSHSFFSVVPPFLALALAVITRRVLLSLGIGILVGVAFLVGGNPVDGLTHLKDMV   60 orf26.pep    VGLAWSDXDWSLGKPKILVFXILLGIFTSLLTYSGSN                          97
             ||||| :| |||||||||||  |||||||||||||||
orf26ng      VGLAWADGDWSLGKPKILVFLILLGIFTSLLTYSGSNQAFADWAKRHIKNRCGAKMLTAC  120
                                            //
orf26.pep                                        TSLVFGGTCGVFAVVLCTLGTIKTADYPKA  326
                                                 |||||||||||:||||| :||||||||||||
orf26ng      ASTVSAMIYTGAQASETFSILGAFENTDVNTSLVFGGTCGVLAVVLCTFGTIKTADYPKA  326 orf26.pep    VWQGAKSMFGAIAILILAWLISTVVGEMETGDYLSTLVAGNIHPGFLPVILFLLASVMAF  386
             ||||||||||||||||||||||||||||||||||||||||||||||||||||||||||||
orf26ng      VWQGAKSMFGAIAILILAWLISTVVGEMETGDYLSTLVAGNIHPGFLPVILFLLASVMAF  386 orf26.pep    ATGTSWGTFGIMLPIAAAMAVKVEPALIIPCMSAVMAGAVCGDHCSPISDTTILSSTGAR  446
             ||||||||||||||||||||||||||||||||||||||||||||||||||||||||||||
orf26ng      ATGTSWGTFGIMLPIAAAMAVKVEPALIIPCMSAVMAGAVCGDHCSPISDTTILSSTGAR  446 orf26.pep    CNHIDHVTSQLPYALTVAAAAASGYLALGLTKSALLGFGTTGIVLAVLIFLLKDKK      502
             ||||||||||||||||||||||||||||||||||||||||||||||||||||||||
orf26ng      CNHIDHVTSQLPYALTVAAAAASGYLALGLTKSALLGFGTTGIVLAVLIFLLKDKKRADV  502
```

The complete length ORF26ng nucleotide sequence <SEQ ID 695> is:

```
  1 ATGCAGCTGA TTGACTATTC ACATTCATTT TTCTCGGTTG
    TGCCACCCTT

51 TTTGGCACTG GCACTTGCCG TCATTACCCG CCGCGTACTG
    CTGTCTTTAG

101 GCATCGGTAT TTTGGTCGGC GTTGCCTTTT TGGTCGGCGG
    CAACCCCGTC

151 GACGGTCTGA CACACCTGAA AGACATGGTC GTCGGCTTGG
    CTTGGGCAGA

201 CGGCGATTGG TCGCTGGGCA AACCAAAAAT CTTGGTTTTC
    CTGATACTTT

251 TGGGCATTTT CACTTCACTG CTGACCTACT CCGGCAGCAA
    TCAGGCGTTT

301 GCCGACTGGG CAAAACGGCA CATTAAAAAC CGGTGCGGCG
    CGAAAATGCT

351 GACCGCCTGC CTCGTGTTCC TAACCTTTAT CGACGACTAT
    TTCCACAGCC

401 TCGCCGTCGG TGCGATTGCC CGCCCCGTTA CCGACAAGTT
    TAAAGTTTCC

451 CGCGCCAAAC TCGCCTACAT CCTCGACTCC ACTGCCTCGC
    CCATGTGCGT

501 GCTGATGCCC GTTTCAAGCT GGGGCGCGTC GATTATCGCC
    ACGCTTGCCG

551 GATTGCTCGT TACCTACAAA ATTACCGAAT ACACGCCCAT
    GGGGACGTTT

601 GTCGCCATGA GCCTGATGAA CTATTACGCG CTGTTTGCCC
    TGATTATGGT
```

```
 651 ATTCGTCGTC GCATGGTTCT CCTTCGACAT CGGCTCGAtg
     gCGCGTTTCG
 701 AACAGGCTGC GTTGAACGAA gcccaggacg aaaccgccgc
     tTCAGACgCT
 751 ACCAAAGGTC GTGTTTACGC ATTGATTATT CCCGTTTTGG
     CCTTAATCGC
 801 CTCAACGGTT TCCGCCATGA TCTACACCGG CGCGCAGGCA
     AGCGAAACCT
 851 TCAGCATTTT GGGGGCATTT GAAAATACCG ACGTAAACAC
     TTCGCTGGTA
 901 TTCGGCGGCA CTTGCGGCGT GCTTGCCGTC GTCCTCTGCA
     CGTTCGGCAC
 951 GATTAAAACC GCCGATTATC CCAAAGCCGT GTGGCAGGGT
     GCGAAATCCA
1001 TGTTCGGCGC AATCGCCATT TTAATCCTCG CCTGGCTCAT
     CAGTACGGTT
1051 GTCGGCGAAA TGCACACGGG CGACTACCTC TCCACGCTGG
     TTGCGGGCAA
1101 CATCCATCCC GGCTTCCTGC CCGTCATCCT CTTCCTGCTC
     GCCAGCGTGA
1151 TGGCGTTTGC CACAGGCACA AGCTGGGGGA CGTTCGGCAT
     TATGCTGCCG
1201 ATTGCCGCCG CCATGGCGGT CAAAGTCGAA CCCGCGCTGA
     TTAtcccGTG
1251 TATGTCCGCA GTAATGGCGG GGGCGGTATG CGGCGACCAC
     TGTTCGCCCA
1301 TCTCCGACAC GACCATCCTG TCGTCCACCG GCGCGCGCTG
     CAACCACATC
1351 GACCACGTTA CCTCGCAACT GCCTTATGCC CTGACGGTTG
     CCGCCGCCGC
1401 CGCATCGGGC TACCTCGCAT GGGTCTGAC AAAATCCGCG
     CTGTTGGGCT
1451 TTGGCACGAC CGGTATTGTA TTGGCGGTGC TGATTTTTCT
     GTTGAAAGAT
1501 AAAAAACGCG CCGACGTTTG A
```

This encodes a protein having amino acid sequence <SEQ ID 696>:

```
  1 MQLIDYSHSF FSVVPPFLAL ALAVITRRVL LSLGIGILVG
    VAFLVGGNPV
 51 DGLTHLKDMV VGLAWADGDW SLGKPKILVF LILLGIFTSL
    LTYSGSNQAF
101 ADWAKRhIKN RCGAKMLTAC LVFVTFIDDY FHSLAVGAIA
    RPVTDKFKVS
151 RAKLAYILDS TASPMCVLMP VSSWGASIIA TLAGLLVTYK
    ITEYTPMGTF
201 VAMSLMNYYA LFALIMVFVV AWFSFDIGSM ARFEQAALNE
    AQDETAASDA
251 TKGRVYALII PVLALIASTV SAMIYTGAQA SETFSILGAF
    ENTDVNTSLV
301 FGGTCGVLAV VLCTFGTIKT ADYPKAVWQG AKSMFGAIAI
    LILAWLISTV
351 VGEMHTGDYL STLVAGNIHP GFLPVILFLL ASVMAFATGT
    SWGTFGIMLP
401 IAAAMAVKVE PALIIPCMSA VMAGAVCGDH CSPISDTTIL
    SSTGARCNHI
451 DHVTSQLPYA LTVAAAAASG YLALGLTKSA LLGFGTTGIV
    LAVLIFLLKD
501 KKRADV*
```

ORF26ng and ORF26-1 show 98.4% identity in 505 aa overlap:

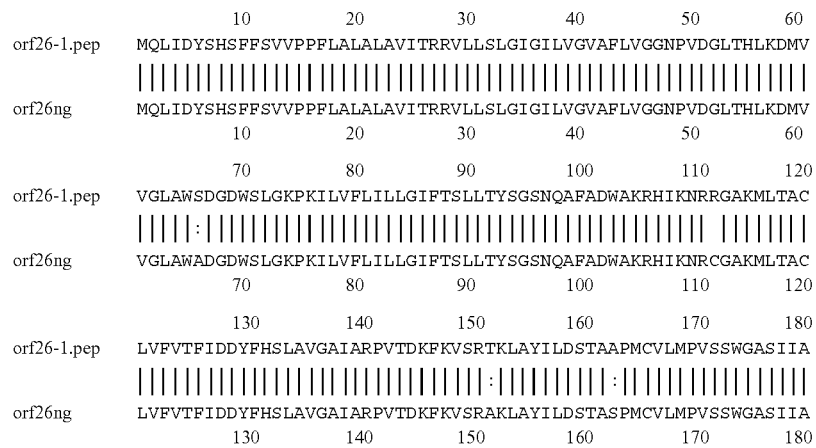

```
                   -continued
                190       200       210       220       230       240
orf26-1.pep    TLAGLLVTYKITEYTPMGTFVAMSLMNYYALFALIMVFVVAWFSFDIGSMARFEQAALNE
               ||||||||||||||||||||||||||||||||||||||||||||||||||||||||||||
orf26ng        TLAGLLVTYKITEYTPMGTFVAMSLMNYYALFALIMVFVVAWFSFDIGSMARFEQAALNE
                190       200       210       220       230       240

250       260       270       280       290       300
orf26-1.pep    AHDETAVSDATKGRVYALIIPVLALIASTVSAMIYTGAQASETFSILGAFENTDVNTSLV
               |:||||:|||||||||||||||||||||||||||||||||||||||||||||||||||||
orf26ng        AQDETAASDATKGRVYALIIPVLALIASTVSAMIYTGAQASETFSILGAFENTDVNTSLV
                250       260       270       280       290       300

310       320       330       340       350       360
orf26-1.pep    FGGTCGVLAVVLCTLGTIKTADYPKAVWQGAKSMFGAIAILILAWLISTVVGEMHTGDYL
               |||||||||||||:||||||||||||||||||||||||||||||||||||||||||||||
orf26ng        FGGTCGVLAVVLCTFGTIKTADYPKAVWQGAKSMFGAIAILILAWLISTVVGEMHTGDYL
                310       320       330       340       350       360

370       380       390       400       410       420
orf26-1.pep    STLVAGNIHPGFLPVILFLLASVMAFATGTSWGTFGIMLPIAAAMAVKVEPALIIPCMSA
               ||||||||||||||||||||||||||||||||||||||||||||||||||||||||||||
orf26ng        STLVAGNIHPGFLPVILFLLASVMAFATGTSWGTFGIMLPIAAAMAVKVEPALIIPCMSA
                370       380       390       400       410       420

430       440       450       460       470       480
orf26-1.pep    VMAGAVCGDHCSPISDTTILSSTGARCNHIDHVTSQLPYALTVAAAAASGYLALGLTKSA
               ||||||||||||||||||||||||||||||||||||||||||||||||||||||||||||
orf26ng        VMAGAVCGDHCSPISDTTILSSTGARCNHIDHVTSQLPYALTVAAAAASGYLALGLTKSA
                430       440       450       460       470       480

490       500
orf26-1.pep    LLGFGTTGIVLAVLIFLLKDKKRANAX
               ||||||||||||||||||||||||::
orf26ng        LLGFGTTGIVLAVLIFLLKDKKRADVX
                490       500
```

In addition, ORF26ng shows significant homology to a hypothetical *H. influenzae* protein:

```
sp|P44263|YF86_HAEIN   HYPOTHETICAL   PROTEIN   HI1586   > gi|1074850|pir| |C64037
hypothetical
protein HI1586 - Haemophilus influenzae (strain Rd KW20) > gi|1574427| (U32832) H.
influenzae predicted coding region HI1586 [Haemophilus influenzae] Length = 519
 Score = 538 bits (1370), Expect = e - 152
 Identities = 280/507 (55%), Positives = 346/507 (68%), Gaps = 7/507 (1%)

Query:    1 MQLIDYSHSFFSVVPPFLALALAVITRRXXXXXXXXXXXXXXXAFLVGGNPVDGLTHLKDMV    60
            M+LID+S S +S+VP  LA+ LA+ TRR               L         +L   V
Sbjct:   14 MELIDFSSSVWSIVPALLAIILAIATRRVLVSLSAGIIGSLMLSDWQIGSAFNYLVKNV    73

Query:   61 VGLAWADGDWSLGKPKILVFLILLGIFTSLLTYSGSNQAFADWAKRHIKNRCGAKMLTAC   120
            V L +ADG+ +     I++FL+LLG+ T+LLT SGSN+AFA+WA+  IK R GAK+L A
Sbjct:   74 VSLVYADGEIN-SNMNIVLFLLLLGVLTALLTVSGSNRAFAEWAQSRIKGRRGAKLLAAS   132

Query:  121 LVFVTFIDDYFHSLAVGAIARPVTDKFKVSRAKLAYILDSTASPMCVLMPVSSWGASIIA   180
            LVFVTFIDDYFHSLAVGAIARPVTD+FKVSRAKLAYILDSTA+PMCV+MPVSSWGA II
Sbjct:  133 LVFVTFIDDYFHSLAVGAIARPVTDRFKVSRAKLAYILDSTAAPMCVMMPVSSWGAYIIT   192

Query:  181 TLAGLLVTYKITEYTPMGTFVAMSLMNYYALFALIMVFVVAWFSFDIGSMARFEQAALNE   240
              +GLL TY ITEYTP+G FVAMS MN+YA+F++IMVF VA+FSFDI SM R E+ AL
Sbjct:  193 LIGGLLATYSITEYTPIGAFVAMSSMNFYAIFSIIMVFFVAYFSFDIASMVRHEKLALKN   252

Query:  241 AQDETAASDATKGRVYALIIPVLALIASTVSAMIYTGAQA----SETFSILGAFENTDVN   296
             +D+    TKG+V  LI+P+L LI +TVS MIYTGA+A      + FS+LG FENT V
Sbjct:  253 TEDQLEEETGTKGQVRNLILPLVLIIATVSMMIYTGAEALAADGKVFSVLGTFENTVVG   312

Query:  297 TSLVFGGTCGVL--AVVLCTFGTIKTADYPKAVWQGAKSMFGXXXXXXXXXXXSTVVGEM   354
            TSLV GG C ++   +++    +  +Y +    G KSM G           + +VG+M
Sbjct:  313 TSLVVGGFCSIIISTLLIILDRQVSVPEYVRSWIVGIKSMSGAIAILFFAWTINKIVGDM   372
```

```
                              -continued
Query: 355 HTGDYLSTLVAGNIHPGFLPVILFLLASVMAFATGTSWGTFGIMLPIAAAMAVKVEPALI 414
           TG YLS+LV+GNI   FLPVILF+L + MAF+TGTSWGTFGIMLPIAAAMA    P L+
Sbjct: 373 QTGKYLSSLVSGNIPMQFLPVILFVLGAAMAFSTGTSWGTFGIMLPIAAAMAANAAPELL 432

Query: 415 IPCMSAVMAGAVCGDHCSPISDTTILSSTGARCNHIDHVTSQXXXXXXXXXXXXXXXXXX 474
           +PC+SAVMAGAVCGDHCSP+SDTTILSSTGA+CNHIDHVT+Q
Sbjct: 433 LPCLSAVMAGAVCGDHCSPVSDTTILSSTGAKCNHIDHVTTQLPYAATVATATSIGYTVV 492

Query: 475 XXXKSALLGFGTTGIVLAVLIFLLKDK                                  501
              S L GF  T + L V+IF +K +
Sbjct: 493 GFTYSGLAGFAATAVSLIVIIFAVKKR                                  519
```

Based on this analysis, it is predicted that these proteins from *N. meningitidis* and *N. gonorrhoeae*, and their epitopes, could be useful antigens for vaccines or diagnostics, or for raising antibodies.

Example 83

The following partial DNA sequence was identified in *N. meningitidis* <SEQ ID 697>:

```
  1 ...AAGCAATGGT ATGCCGACGN .AGTATCAAG ACGGAAATGG
        TTATGGTCAA
 51    CGATGAGCCT GCCAAAATTC TGACTTGGGA TGAAAGCGGC
        CGATTACTCT
101    CGGAACTGTC TATCCGCCAC CATCAACGCA ACGGGGTGGT
        TTTGGAGTGG
151    TATGAAGATG GTTCTAAAAA GAGCGAAGT. GTTTATCAGG
        ATGACAAGTT
201    GGTCAGGAAA ACCCAGTGGG ATAAGGATGG TTATTTAATC
        GAACCCTGA
```

This corresponds to the amino acid sequence <SEQ ID 698; ORF27>:

```
  1 ...KQWYADXSIK TEMVMVNDEP AKILTWDESG RLLSELSIRH
        HQRNGVVLEW
 51    YEDGSKKSEX VYQDDKLVRK TQWDKDGYLI EP*
```

Further work revealed the complete nucleotide sequence <SEQ ID 699>:

```
  1 ATGAAAAAAT TATCTCGGAT TGTATTTTCA ACTGTCCTGT
        TGGGTTTTTC
 51 GGCCGCTTTG CCGGCGCAGA CCTATTCTGT TTATTTTAAT
        CAGAACGGAA
101 AGCTGACGGC GACGATGTCT TCTGCCGCTT ATATCAGGCA
        ATATAGTGTG
151 GTGGCGGGTA TTGCGCACGC GCAGGATTTT TATTATCCGT
        CGATGAAGAA
201 ATATTCTGAA CCTTATATCG TTCCTTCAAC GCAAATCAAA
        TCTTTTGTGC
251 CTACCCTGCA AAACGGTATG TTGATTTTGT GGCATTTTAA
        TGGTCAGAAA
301 AAAATGGCGG GGGGCTTCAG CAAGGGTAAG CCGGACGGGG
        AGTGGGTCAA
351 CTGGTATCCG AACGGTAAAA AATCTGCCGT TATGCCTTAT
        AAAAATGGCT
401 TGAGTGAGGG TACGGCATAC CGCTATTACC GTAACGGCGG
        CAAGGAAAGC
451 GAAATCCAGT TTAAGCAAAA TAAGGCAAAC GGCGTATGGA
        AGCAATGGTA
501 TGCCGACGGC AGTATCAAGA CGGAAATGGT TATGGTCAAC
        GATGAGCCTG
551 CCAAAATTCT GACTTGGGAT GAAAGCGGCC GATTACTCTC
        GGAACTGTCT
601 ATCCGCCACC ATCAACGCAA CGGGGTGGTT TTGGAGTGGT
        ATGAAGATGG
651 TTCTAAAAAG AGCGAAGCTG TTTATCAGGA TGACAAGTTG
        GTCAGGAAAA
701 CCCAGTGGGA TAAGGATGGT TATTTAATCG AACCCTGA
```

This corresponds to the amino acid sequence <SEQ ID 700; ORF27-1>:

```
  1 MKKLSRIVFS TVLLGFSAAL PAQTYSVYFN QNGKLTATMS
       SAAYIRQYSV
 51 VAGIAHAQDF YYPSMKKYSE PYIVASTQIK SFVPTLQNGM
       LILWHFNGQK
101 KMAGGFSKGK PDGEWVNWYP NGKKSAVMPY KNGLSEGTGY
       RYYRNGGKES
151 EIQFKQNKAN GVWKQWYADG SIKTEMVMVN DEPAKILTWD
       ESGRLLSELS
201 IRHHQRNGVV LEWYEDGSKK SEAVYQDDKL VRKTQWDKDG
       YLIEP*
```

Computer analysis of this amino acid sequence gave the following results:

Homology with a Predicted ORF from *N. meningitidis* (Strain A)

ORF27 shows 91.5% identity over a 82aa overlap with an ORF (ORF27a) from strain A of *N. meningitidis*:

```
            10        20         30
orf27.pep                    KQWYADXSIKTEMVMVNDEPAKILTWDESG
                             ||||||:||||||||||||||||||||||
orf27a    LSEGTGXRYYRNGGKESEIQFKQNKANGVWKQWYADGNIKTEMVMVNDEPAKILTWDESG
            140       150        160       170       180       190
             40        50         60       70        80
orf27.pep RLLSELSIRHHQRNGVVLEWYEDGSKKSEXVYQDDKLVRKTQWDKDGYLIEPX
          ||||||||:|||||||||||||||||||:||||||||||||||||||||||
orf27a    RLLSELSIHHHXRNGVVLEWYEDGSKKXEAVYQDDKLVRKTQWDKDGYLIEPX
            200       210       220       230       240
```

The complete length ORF27a nucleotide sequence <SEQ ID 701> is:

```
  1 ATGAAAAAAT TATCTCGGAT TGTATTTTCA ACTGTCCTGT
    TGGGTTTTTC
 51 GGCCGCTTTG CCGGCGCAGA NCTATTCTGT TTATTTTAAT
    CAGAACGGGA
101 AACTGACGGC GACGNTGTCT TCTGCCGCNT ATATCAGGCA
    ATATAGTGTG
151 GCGGAGGGTA TTGCGCACGC GCAGGANTTT TANTATCCGT
    CGATGAAGAA
201 ATATTCCGAA CCTTATATCG TTGCTTCAAC GCAAATCAAA
    TCTTTTGTGC
251 CTACCCTGCA AAACGGTATG TTGATTTTGT GGCATTTTAA
    NGGTCAGAAA
301 AAAATGGCNG GGGGCTTCAG CAAGGGTAAG CCGGACGGGG
    AGTGGGTCAA
351 CTGGTATCCG AACGGTAAAA AATCTGCCGT TATGCCTTAT
    AAAAATGGTT
401 TGAGTGAAGG TACGGGGTNN CGCTATTACC GTAACGGCGG
    CAAGGAAAGC
451 GAAATCCAGT TTAAACAGAA TAAGGCAAAC GGCGTATGGA
    AGCAATGGTA
501 TGCCGACGGC AATATCAAAA CGGAAATGGT TATGGTCAAT
    GATGAGCCTG
551 CCAAAATTCT GACATGGGAT GAAAGCGGTC GATTACTCTC
    GGAACTGTCT
601 ATCCATCATC ATNAACGTAA TGGAGTAGTC TTAGAGTGGT
    ATGAAGATGG
651 TTCTAAAAAG ANTGAAGCTG TTTATCAGGA TGATAAGTTG
    GTCAGGAAAA
701 CCCAGTGGGA TAANGATGGT TATTTAATCG AACCCTGA
```

This encodes a protein having amino acid sequence <SEQ ID 702>:

```
  1 MKKLSRIVFS TVLLGFSAAL PAQXYSVYFN QNGKLTATXS
    SAAYIRQYSV
 51 AEGIAHAQXF XYPSMKKYSE PYIVASTQIK SFVPTLQNGM
    LILWHFNGQK
101 KMAGGFSKGK PDGEWVNWYP NGKKSAVMPY KNGLSEGTGX
    RYYRNGGKES
151 EIQFKQNKAN GVWKQWYADG NIKTEMVMVN DEPAKILTWD
    ESGRLLSELS
201 IHHHXRNGVV LEWYEDGSKK XEAVYQDDKL VRKTQWDKDG
    YLIEP*
```

ORF27a and ORF27-1 show 94.7% identity in 245 aa overlap:

```
              10         20         30        40         50        60
orf27a.pep MKKLSRIVFSTVLLGFSAALPAQXYSVYFNQNGKLTATXSSAAYIRQYSVAEGIAHAQXF
           ||||||||||||||||||||||:|||||||||||||||||||||||||||:||||||:|
orf27-1    MKKLSRIVFSTVLLGFSAALPAQTYSVYFNQNGKLTATMSSAAYIRQYSVVAGIAHAQDF
              10         20         30        40         50        60
              70         80         90       100        110       120
orf27a.pep XYPSMKKYSEPYIVASTQIKSFVPTLQNGMLILWHFXGQKKMAGGFSKGKPDGEWVNWYP
           ||||||||||||||||||||||||||||||||||||:|||||||||||||||||||||||
orf27-1    YYPSMKKYSEPYIVASTQIKSFVPTLQNGMLILWHFNGQKKMAGGFSKGKPDGEWVNWYP
              70         80         90       100        110       120
              130        140        150       160        170       180
orf27a.pep NGKKSAVMPYKNGLSEGTGXRYYRNGGKESEIQFKQNKANGVWKQWYADGNIKTEMVMVN
           |||||||||||||||||||:|||||||||||||||||||||||||||||:|||||||||
orf27-1    NGKKSAVMPYKNGLSEGTGYRYYRNGGKESEIQFKQNKANGVWKQWYADGSIKTEMVMVN
              130        140        150       160        170       180
              190        200        210       220        230       240
orf27a.pep DEPAKILTWDESGRLLSELSIHHHXRNGVVLEWYEDGSKKXEAVYQDDKLVRKTQWDXDG
           ||||||||||||||||||||:||||||||||||||||||||||||||||||||||||:||
orf27-1    DEPAKILTWDESGRLLSELSIRHHQRNGVVLEWYEDGSKKSEAVYQDDKLVRKTQWDKDG
              190        200        210       220        230       240
```

```
orf27a.pep  YLIEPX
            ||||||
orf27-1     YLIEPX
```

Homology with a Predicted ORF from *N. gonorrhoeae*
ORF27 shows 96.3% identity over 82 aa overlap with a predicted ORF (ORF27ng) from *N. gonorrhoeae*:

```
orf27.pep                KQWYADXSIKTEMVMVNDEPAKILTWDESG   30
                         |||||| |||||||||||||||||||||||
orf27ng    LSEGTGYRYYRNGGKESEIQFKQNKANGVWKQWYADGSIKTEMVMVNDEPAKILTWDESG  193
orf27.pep  RLLSELSIRHHQRNGVVLEWYEDGSKKSEXVYQDDKLVRKTQWDKDGYLIEP   82
           |||||||||||:||||||||||||||| ||||||||||||||||||||||||
orf27ng    RLLSELSIRHHKRNGVVLEWYEDGSKKXEAVYQDDKLVRKTQWDKDGYLIEP  245
```

The complete length ORF27ng nucleotide sequence <SEQ ID 703> is:

```
  1 ATGAAGAAAT TATCTCGGAT TGTATTTTCA ATCGTACTGT
    TGGGTTTTTC
 51 GGCCGCTTTG CCGCCGCAGA CCTATTCTGT TTATTTTAAT
    CAGAACGGGA
101 AACTGACGGC GACGATGTCT TCTGCCCCTT ATATCAGGCA
    ATATAGTGTG
151 GCGGCGGGTA TCGCACACGC GCAGGATTTT TATTATCCGT
    CGATGAAGAA
201 ATATTCCGAA CCTTATATCG TTGCTTCAAC GCAAATCAAA
    TCTTTTGTGC
251 CTACCCTGCA AAACGGTATG TTGATTTTGT GGCATTTTAA
    TGGTCAGAAA
301 AAAATGGCGG GGGGCTTCAG CAAGGGTAAG CCGGACGGGG
    AATGGGTCAA
351 CTGGTATCCG AACGGTAAAA AATCTGCGGT TATGCCTTAT
    AAAAATGGCT
401 TGAGTGAGGG TACGGGATAC CGTTATTACC GTAACGGCGG
    CAAGGAAAGC
451 GAAATCCAGT TTAAGCAAAA TAAGGCGAAC GGCGTATGGA
    AGCAATGGTA
501 TGCCGATGGA AGTATCAAGA CGGAAATGGT TATGGTCAAC
    GATGAGCCTG
551 CCAAAATTCT GACTTGGGAT GAAAGCGGCC GATTACTTTC
    GGAACTGTCT
601 ATCCGCCACC ATAAACGCAA CGGGGTGGTT TTGGAGTGGT
    ATGAAGATGG
651 TTCTAAAAAG AGCGAGGCTG TTTATCAGGA TGACAAGTTG
    GTCAGGAAAA
701 CCCAATGGGA TAAGGATGGT TATTTAATCG AACCCTGA
```

This encodes a protein having amino acid sequence <SEQ ID 704>:

```
  1 MKKLSRIVFS IVLLGFSAAL PAQTYSVYFN QNGKLTATMS
    SAAYIRQYSV
 51 AAGIAHAQDF YYPSMKKYSE PYIVASTQIK SFVPTLQNGM
    LILWHFNGQK
101 KMAGGFSKGK PDGEWVNWYP NGKKSAVMPY KNGLSEGTGY
    RYYRNGGKES
151 EIQFKQNKAN GVWKQWYADG SIKTEMVMVN DEPAKILTWD
    ESGRLLSELS
201 IRHHKRNGVV LEWYEDGSKK SEAVYQDDKL VRKTQWDKDG
    YLIEP*
```

ORF27ng and ORF27-1 show 98.8% identity in 245 aa overlap:

```
                       10         20         30         40         50         60
orf27-1.pep  MKKLSRIVFSTVLLGFSAALPAQTYSVYFNQNGKLTATMSSAAYIRQYSVVAGIAHAQDF
             |||||||||| ||||||||||||||||||||||||||||||||||||||:|||||||||
orf27ng      MKKLSRIVFSIVLLGFSAALPAQTYSVYFNQNGKLTATMSSAAYIRQYSVAAGIAHAQDF
                      10         20         30         40         50         60

70         80         90        100        110        120
orf27-1.pep  YYPSMKKYSEPYIVASTQIKSFVPTLQNGMLILWHFNGQKKMAGGFSKGKPDGEWVNWYP
             ||||||||||||||||||||||||||||||||||||||||||||||||||||||||||||
orf27ng      YYPSMKKYSEPYIVASTQIKSFVPTLQNGMLILWHFNGQKKMAGGFSKGKPDGEWVNWYP
                      70         80         90        100        110        120
```

```
                    130        140        150        160        170        180
orf27-1.pep  NGKKSAVMPYKNGLSEGTGYRYYRNGGKESEIQFKQNKANGVWKQWYADGSIKTEMVMVN
             ||||||||||||||||||||||||||||||||||||||||||||||||||||||||||||
orf27ng      NGKKSAVMPYKNGLSEGTGYRYYRNGGKESEIQFKQNKANGVWKQWYADGSIKTEMVMVN
                    130        140        150        160        170        180

190        200        210        220        230        240
orf27-1.pep  DEPAKILTWDESGRLLSELSIRHHQRNGVVLEWYEDGSKKSEAVYQDDKLVRKTQWDXDG
             |||||||||||||||||||||||:||||||||||||||||||||||||||||||||||
orf27ng      DEPAKILTWDESGRLLSELSIRHHKRNGVVLEWYEDGSKKSEAVYQDDKLVRKTQWDKDG
                    190        200        210        220        230        240 orf27-1.pep  YLIEPX
             ||||||
orf27ng      YLIEPX
```

Based on this analysis, including the putative leader sequence in the gonococcal protein, it was predicted that the proteins from *N. meningitidis* and *N. gonorrhoeae*, and their epitopes, could be useful antigens for vaccines or diagnostics, or for raising antibodies.

ORF27-1 (24.5 kDa) was cloned in pET and pGex vectors and expressed in *E. coli*, as described above. The products of protein expression and purification were analyzed by SDS-PAGE. FIG. 17A shows the results of affinity purification of the GST-fusion protein, and FIG. 17B shows the results of expression of the His-fusion in *E. coli*. Purified GST-fusion protein was used to immunise mice, whose sera were used for ELISA, which gave a positive result, confirming that ORF27-1 is a surface-exposed protein and a useful immunogen.

Example 84

The following partial DNA sequence was identified in *N. meningitidis* <SEQ ID 705>:

```
  1 ATGAAATTTA CCAAGCACCC CGTCTGGGCA ATGGCGTTCC
    GCCCATTTTA
 51 TTCGCTGGCG GCTCTGTACG GCGCATTGTC CGTATTGCTG
    TGGGGTTTCG
101 GCTACACGGG AACGCACkAG CTGTCCGGTT TCTATTGGCA
    CGCGCATGAg
151 ATGATTTGGG GTTATGCCGG ACTGGTCGTC ATCGCCTTCC
    TGCTGACCGC
201 CGTCGCCACT TGGACGGGGC AGCCGCCCAC GCGGGGCGGC
    GTaTCTGGTC
251 GGCTTGACTA TCTTTTGGCT GGCTGCGCGG ATTGCCGCCT
    TTATCCCGGG
301 TTGGGGTGCG TCGGCAAGCG GCATACTCGG TACGCTGTTT
    TTCTGGTACG
351 GCGCGGTGTG CATGGCTTTG CCCGTTATCC GTTCGCAGAA
    TCAACGCAAC
401 TATGTTgCCG TGTTCGCGCT GTTCGTCTTG GGCGCCACGC
    ATGCGGCGTT
451 CCACGTCCAG CTGCACAACG GCAACCTAGG CGGACTCTTG
    AGCGGATTGC
501 AGTCGGGCTT GGTGATG
```

This corresponds to the amino acid sequence <SEQ ID 706; ORF47>:

```
  1 MKFTKHPVWA MAFRPFYSLA ALYGALSVLL WGFGYTGTHX
    LSGFYWHAHE
 51 MIWGYAGLVV IAFLLTAVAT WTGQPPTRGG VLVGLTIFWL
    AARIAAFIPG
101 WGASASGILG TLFFWYGAVC MALPVIRSQN QRNYVAVFAL
    FVLGGTHAAF
151 HVQLHNGNLG GLLSGLQSGL VM
```

Further work revealed the complete nucleotide sequence <SEQ ID 707>:

```
  1 ATGAAATTTA CCAAGCACCC CGTCTGGGCA ATGGCGTTCC
    GCCCATTTTA
 51 TTCGCTGGCG GCTCTGTACG GCGCATTGTC CGTATTGCTG
    TGGGGTTTCG
101 GCTACACGGG AACGCACGAG CTGTCCGGTT TCTATTGGCA
    CGCGCATGAG
151 ATGATTTGGG GTTATGCCGG ACTGGTCGTC ATCGCCTTCC
    TGCTGACCGC
201 CGTCGCCACT TGGACGGGGC AGCCGCCCAC GCGGGGCGGC
    GTTCTGGTCG
251 GCTTGACTAT CTTTTGGCTG GCTGCGCGGA TTGCCGCCTT
    TATCCCGGGT
301 TGGGGTGCGT CGGCAAGCGG CATACTCGGT ACGCTGTTTT
    TCTGGTACGG
351 CGCGGTGTGC ATGGCTTTGC CCGTTATCCG TTCGCAGAAT
    CAACGCAACT
401 ATGTTGCCGT GTTCGCGCTG TTCGTCTTGG GCGGCACGCA
    TGCGGCGTTC
451 CACGTCCAGC TGCACAACGG CAACCTAGGC GGACTCTTGA
    GCGGATTGCA
501 GTCGGGCTTG GTGATGGTGT CGGGTTTTAT CGGTCTGATT
    GGTACGCGGA
551 TTATTTCGTT TTTTACGTCC AAACGCTTGA ATGTGCCGCA
    GATTCCCAGT
601 CCGAAATGGG TGGCGCAGGC TTCGCTGTGG CTGCCCATGC
    TGACTGCCAT
651 GCTGATGGCG CACGGTGTGT TGGCTTGGCT GTCTGCCGTT
    TTTGCCTTTG
701 CGGCAGGTGT GATTTTTACC GTGCAGGTGT ACCGCTGGTG
    GTATAAACCC
```

-continued

```
751 GTGTTGAAAG AGCCGATGCT GTCGATTCTG TTTGCCGGCT
    ATCTGTTTAC

801 CGGATTGGGG CTGATTGCGG TCGGCGCGTC TTATTTCAAA
    CCCGCTTTCC

851 TCAATCTGGG TGTGCATCTG ATCGGGGTCG GCGGTATCGG
    CGTGCTGACT

901 TTGGGCATGA TGGCGCGTAC CGCGCTTGGT CATACGGGCA
    ATCCGATTTA

951 TCCGCCGCCC AAAGCCGTTC CCGTTGCGTT TTGGCTGATG
    ATGGCGGCAA
```

-continued

```
1001 CCGCCGTCCG TATGGTTGCC GTATTTTCTT CCGGCACTGC
     CTACACGCAC

1051 AGCATCCGCA CCTCTTCGGT TTTGTTTGCA CTCGCGCTTT
     TGGTGTATGC

1101 GTGGAAGTAT ATTCCTTGGC TGATTCGTCC GCGTTCGGAC
     GGCAGGCCCG

1151 GTTGA
```

This corresponds to the amino acid sequence <SEQ ID 708; ORF47-1>:

```
  1 MKFTKHPVWA MAFRPFYSLA ALYGALSVLL WGFGYTGTHE LSGFYWHAHE

51 MIWGYAGLVV IAFLLTAVAT WTGQPPTRGG VLVGLTIFWL AARIAAFIPG

101 WGASASGILG TLFFWYGAVC MALPVIRSQN QRNYVAVFAL FVLGGTHAAF

151 HVQLHNGNLG GLLSGLQSGL VMVSGFIGLI GTRIISFFTS KRLNVPQIPS

201 PKWVAQASLW LPMLTAMLMA HGVLAWLSAV FAFAAGVIFT VQVYRWWYKP

251 VLKEPMLWIL FAGYLFTGLG LIAVGASYFK PAFLNLGVHL IGVGGIGVLT

301 LGMMARTALG HTGNPIYPPP KAVPVAFWLM MAATAVRMVA VFSSGTAYTH

351 SIRTSSVLFALALLVYAWKY IPWLIRPRSD GRPG*
```

Computer analysis of this amino acid sequence predicts a leader peptide and also gave the following results:

Homology with a Predicted ORF from *N. meningitidis* (Strain A)

ORF47 shows 99.4% identity over a 172aa overlap with an ORF (ORF47a) from strain A of *N. meningitidis*:

```
                 10         20         30         40         50         60
orf47.pep   MKFTKHPVWAMAFRPFYSLAALYGALSVLLWGFGYTGTHXLSGFYWHAHEMIWGYAGLVV
            ||||||||||||||||||||||||||||||||||||||| ||||||||||||||||||||
orf47a      MKFTKHPVWAMAFRPFYSLAALYGALSVLLWGFGYTGTHELSGFYWHAHEMIWGYAGLVV
                 10         20         30         40         50         60

70         80         90        100        110        120
orf47.pep   IAFLLTAVATWTGQPPTRGGVLVGLTIFWLAARIAAFIPGWGASASGILGTLFFWYGAVC
            ||||||||||||||||||||||||||||||||||||||||||||||||||||||||||||
orf47a      IAFLLTAVATWTGQPPTRGGVLVGLTIFWLAARIAAFIPGWGASASGILGTLFFWYGAVC
                 70         80         90        100        110        120

130        140        150        160        170
orf47.pep   MALPVIRSQNQRNYVAVFALFVLGGTHAAFHVQLHNGNLGGLLSGLQSGLVM
            ||||||||||||||||||||||||||||||||||||||||||||||||||||
orf47a      MALPVIRSQNQRNYVAVFALFVLGGTHAAFHVQLHNGNLGGLLSGLQSGLVMVSGFIGLI
                130        140        150        160        170        180 orf47a      GTRIISFFTSKRLNVPQIPSPKWVAQASLWLPMLTAMLMAHGVMPWLSAAFAFAAGVIFT
                190        200        210        220        230        240
```

The complete length ORF47a nucleotide sequence <SEQ ID 709> is:

```
  1 ATGAAATTTA CCAAGCACCC CGTTTGGGCA ATGGCGTTCC GCCCGTTTTA

51 TTCACTGGCG GCTCTGTACG GCGCATTGTC CGTATTGCTG TGGGGTTTCG

101 GCTACACGGG AACGCACGAG CTGTCCGGTT TCTATTGGCA CGCGCATGAG

151 ATGATTTGGG GTTATGCCGG ACTGGTCGTC ATCGCCTTCC TGCTGACCGC
```

```
 201 CGTCGCCACT TGGACGGGGC AGCCGCCCAC GCGGGGCGGC GTTCTGGTCG
 251 GCTTGACTAT CTTTTGGCTG GCTGCGCGGA TTGCCGCCTT TATCCCGGGT
 301 TGGGGTGCGT CGGCAAGCGG CATACTCGGT ACGCTGTTTT TCTGGTACGG
 351 CGCGGTGTGC ATGGCTTTGC CCGTTATCCG TTCGCAGAAT CAACGCAATT
 401 ATGTTGCCGT GTTCGCGCTG TTCGTCTTGG GCGGTACGCA CGCGGCGTTC
 451 CACGTCCAGC TGCACAACGG CAACCTAGGC GGACTCTTGA GCGGATTGCA
 501 GTCGGGCTTG GTGATGGTGT CGGGTTTTAT CGGTCTGATT GGTACGCGGA
 551 TTATTTCGTT TTTTACGTCC AAACGGTTGA ATGTGCCGCA GATTCCCAGT
 601 CCGAAATGGG TGGCGCAGGC TTCGCTGTGG CTGCCCATGC TGACCGCCAT
 651 GCTGATGGCA CACGGCGTGA TGCCTTGGCT GTCGGCGGCT TTCGCGTTTG
 701 CGGCAGGTGT GATTTTTACC GTGCAGGTGT ACCGCTGGTG GTATAAGCCT
 751 GTGTTGAAAG AGCCGATGCT GTGGATTCTG TTTGCCGGCT ATCTGTTTAC
 801 CGGATTGGGG CTGATTGCGG TCGGCGCGTC TTATTTCAAA CCCGCTTTCC
 851 TCAATCTGGG TGTGCATCTG ATCGGGGTCG GCGGTATCGG CGTGCTGACT
 901 TTGGGCATGA TGGCGCGTAC CGCGCTCGGT CATACGGGCA ATCCGATTTA
 951 TCCGCCGCCC AAAGCCGTTC CCGTTGCGTT TTGGCTGATG ATGGCGGCAA
1001 CCGCCGTCCG TATGGTTGCC GTATTTTCTT CCGGCACTGC CTACACGCAC
1051 AGCATACGCA CCTCTTCGGT TTTGTTTGCA CTCGCGCTTT TGGTGTATGC
1101 GTGGAAGTAT ATTCCTTGGC TGATTCGTCC GCGTTCGGAC GGCAGGCCCG
1151 GTTGA
```

This encodes a protein having amino acid sequence <SEQ ID 710>:

```
  1 MKFTKHPVWA MAFRPFYSLA ALYGALSVLL WGFGYTGTHE LSGFYWHAHE
 51 MIWGYAGLVV IAFLLTAVAT WTGQPPTRGG VLVGLTIFWL AARIAAFIPG
101 WGASASGILG TLFFWYGAVC MALFVIRSQN QRNYVAVFAL FVLGGTHAAF
151 HVQLHNGNLG GLLSGLQSGL VMVSGFIGLI GTRIISFFTS KRLNVPQIPS
201 PKWVAQASLW LPMLTAMLMA HGVMPWLSAA FAFAAGVIFT VQVYRWWYKP
251 VLKEPMLWIL FAGYLFTGLG LIAVGASYFK PAFLNLGVHL IGVGGIGVLT
301 LGMMARTALG HTGNPIYPPP KAVPVAFWLM MAATAVRMVA VFSSGTAYTH
351 SIRTSSVLFA LALLVYAWKY IPWLIRPRSD GRPG*
```

ORF47a and ORF47-1 show 99.2% identity in 384 aa overlap:

```
                  10         20         30         40         50         60
orf47a.pep  MKFTKHPVWAMAFRPFYSLAALYGALSVLLWGFGYTGTHELSGFYWHAHEMIWGYAGLVV
            ||||||||||||||||||||||||||||||||||||||||||||||||||||||||||||
orf47-1     MKFTKHPVWAMAFRPFYSLAALYGALSVLLWGFGYTGTHELSGFYWHAHEMIWGYAGLVV
                  10         20         30         40         50         60
```

```
                        70        80        90       100       110       120
orf47a.pep   IAFLLTAVATWTGQPPTRGGVLVGLTIFWLAARIAAFIPGWGASASGILGTLFFWYGAVC
             ||||||||||||||||||||||||||||||||||||||||||||||||||||||||||||
orf47-1      IAFLLTAVATWTGQPPTRGGVLVGLTIFWLAARIAAFIPGWGASASGILGTLFFWYGAVC
                        70        80        90       100       110       120

130       140       150       160       170       180
orf47a.pep   MALPVIRSQNQRNYVAVFALFVLGGTHAAFHVQLHNGNLGGLLSGLQSGLVMVSGFIGLI
             ||||||||||||||||||||||||||||||||||||||||||||||||||||||||||||
orf47-1      MALPVIRSQNQRNYVAVFALFVLGGTHAAFHVQLHNGNLGGLLSGLQSGLVMVSGFIGLI
                       130       140       150       160       170       180

190       200       210       220       230       240
orf47a.pep   GTRIISFFTSKRLNVPQIPSPKWVAQASLWLPMLTAMLMAHGVMPWLSAAFAFAAGVIFT
             |||||||||||||||||||||||||||||||||||||||||||| ||||:||||||||||
orf47-1      GTRIISFFTSKRLNVPQIPSPKWVAQASLWLPMLTAMLMAHGVLAWLSAVFAFAAGVIFT
                       190       200       210       220       230       240

250       260       270       280       290       300
orf47a.pep   VQVYRWWYKPVLKEPMLWILFAGYLFTGLGLIAVGASYFKPAFLNLGVHLIGVGGIGVLT
             ||||||||||||||||||||||||||||||||||||||||||||||||||||||||||||
orf47-1      VQVYRWWYKPVLKEPMLWILFAGYLFTGLGLIAVGASYFKPAFLNLGVHLIGVGGIGVLT
                       250       260       270       280       290       300

310       320       330       340       350       360
orf47a.pep   LGMMARTALGHTGNPIYPPPKAVPVAFWLMMAATAVRMVAVFSSGTAYTHSIRTSSVLFA
             ||||||||||||||||||||||||||||||||||||||||||||||||||||||||||||
orf47-1      LGMMARTALGHTGNPIYPPPKAVPVAFWLMMAATAVRMVAVFSSGTAYTHSIRTSSVLFA
                       310       320       330       340       350       360

370       380
orf47a.pep   LALLVYAWKYIPWLIRPRSDGRPGX
             |||||||||||||||||||||||||
orf47-1      LALLVYAWKYIPWLIRPRSDGRPGX
                       370       380
```

Homology with a Predicted ORF from *N. gonorrhoeae*

ORF47 shows 97.1% identity over 172 aa overlap with a predicted ORF (ORF47ng) from *N. gonorrhoeae*:

```
ORF47     MKFTKHPVWAMAFRPFYSLAALYGALSVLLWGFGYTGTHELSGFYWHAHEMIWGYAGLVV     60
          ||||||||||||||||||||||||||||||||||||||||||||||||||||||||||||
ORF47ng   MKFTKHPVWAMAFRPFYSLAALYGALSVLLWGFGYTGTHELSGFYWHAHEMIWGYAGLVV     60

ORF47     IAFLLTAVATWTGQPPTRGGVLVGLTIFWLAARIAAFIPGWGASASGILGTLFFWYGAVC    120
          |||||||||||||||||||||||||||| |||||||||||||||:|||||||||||||||
ORF47ng   IAFLLTAVATWTGQPPTRGGVLVGLTAFWLAARIAAFIPGWGAAASGILGTLFFWYGAVC    120

ORF47     MALPVIRSQNQRNYVAVFALFVLGGTHAAFHVQLHNGNLGGLLSGLQSGLVM            172
          |||||||||:||||||||:|||||||||||||||||||||||||||||||||
ORF47ng   MALPVIRSQNRRNYVAVFAIFVLGGTHAAFHVQLHNGNLGGLLSGLQSGLVMVWGFIGLI    180
```

The ORF47ng nucleotide sequence <SEQ ID 711> is predicted to encode a protein comprising amino acid sequence <SEQ ID 712>:

```
  1 MKFTKHPVWA MAFRPFYSLA ALYGALSVLL WGFGYTGTHE LSGFYWHAHE

51 MIWGYAGLVV IAFLLTAVAT WTGQPPTRGG VLVGLTAFWL AARIAAFIPG

101 WGAAASGILG TLFFWYGAVC MALPVIRSQN RRNYVAVFAI FVLGGTHAAF

151 HVQLHNGNLG GLLSGLQSGL VMVWGFIGLI GMKIISFFTS KRLKLPQIPS

201 PKWVAHASLW LPMLNAILMA HRVMPWLSAA FPFAAGVIFT VQVYAGGITP

251 IEETSCGSVA GICYRLGNSS G
```

The predicted leader peptide and transmembrane domains are identical (except for an Ile/Ala substitution at residue 87 and an Leu/Ile substitution at position 140) to sequences in the meningococcal protein (see also *Pseudomonas stutzeri* orf396, accession number e246540):

| TM segments in ORF47ng | | | |
|---|---|---|---|
| INTEGRAL | Likelihood = −5.63 | Transmembrane | 52-68 |
| INTEGRAL | Likelihood = −3.88 | Transmembrane | 169-185 |
| INTEGRAL | Likelihood = −3.08 | Transmembrane | 82-98 |
| INTEGRAL | Likelihood = −1.91 | Transmembrane | 134-150 |

-continued

| TM segments in ORF47ng | | | |
|---|---|---|---|
| INTEGRAL | Likelihood = −1.44 | Transmembrane | 107-123 |
| INTEGRAL | Likelihood = −1.38 | Transmembrane | 227-243 |

Further work revealed the complete gonococcal DNA sequence <SEQ ID 713>:

```
   1 ATGAAATTTA CCAAACATCC CGTCTGGGCA ATGGCGTTCC GCCCGTTTTA
  51 TTCACTGGCG GCACTGTACG GCGCATTGTC CGTATTGCTG TGGGGTTTCG
 101 GCTACACGGG AACGCACGAG CTGTCCGGTT TCTATTGGCA CGCGCATGAG
 151 ATGATTTGGG GTTATGCCGG TCTCGTCGTC ATCGCCTTCC TGCTGACCGC
 201 CGTCGCCACT TGGACGGGAC AGCCGCCCAC GAGGGGCGGC GTTCTGGTCG
 251 GCTTGACCGC CTTTTGGCTG GCTGCGCGGA TTGCCGCCTT TATCCCGGGT
 301 TGGGGTGCGG CGGCAAGCGG CATACTCGGT ACGCTGTTTT TCTGGTACGG
 351 CGCGGTGTGC ATGGCTTTGC CCGTTATCCG TtcgCAAAAC CGGCGCAACT
 401 ATGtcgCCGT ATTCGCAATA TTTGTGCTGG GCGGTACGCA TGCGgcgTTC
 451 CACGtccAgc tGCACAACGG CAACCTAGGC GGACTCTTGA GCGGATTGCA
 501 GTCGGGCCTG GTTATGGTGT CGGGCTTTAT CGGCCTGATT GGGATGAGGA
 551 TTATTTCGTT TTTTACGTCC AAACGGTTGA ACGTGCCGCA GATTCCCAGT
 601 CCGAAATGGG TGGCGCAGGC TTCGCTGTGC CTACCCATGC TGACCGCCAT
 651 ACTGATGGCG CACGGCGTGA TGCCTTGGCT GTCGGCGGCT TTCGCGTTTG
 701 CGGCGGGCGT GATTTTTACC GTACAGGTGT ACCGCTGGTG GTATAAACCC
 751 GTATTGAAAG AACCGATGCT GTGGATTCTG TTTGCCGGCT ATCTGTTTAC
 801 CGGATTGGGG CTGATTGCGG TCGGCGCGTC TTATTTCAAA CCTGCCTTCC
 851 TCAATCTGGG CGTACATCTG ATCGGGGTCG GCGGTATCGG CGTGCTGACT
 901 TTGGGCATGA TGGCGCGTAC CGCGCTCGGT CATACGGGCA ATTCGATTTA
 951 TCCGCCGCCC AAAGCCGTTC CCGTTGCGTT TTGGCTGATG ATGGCGGCAA
1001 CCGCCGTCCG TATGGTTGCC GTATTTTCTT CCGGCACTGC CTACACGCAC
1051 AGCATCCGCA CGTCTTCGGT TTTGTTTGCA CTCGCGCTGC TGGTGTATGC
1101 GTGGAAATAC ATTCCGTGGC TGATCCGTCC GCGTTCGGAC GGCAGGCCCG
1151 GTTGA
```

This encodes a protein having amino acid sequence <SEQ ID 714; ORF47ng-1>:

```
   1 MKFTKHPVWA MAFRPFYSLA ALYGALSVLL WGFGYTGTHE LSGFYWHAHE
  51 MIWGYAGLVV IAFLLTAVAT WTGQPPTRGG VLVGLTAFWL AARIAAFIPG
 101 WGAAASGILG TLFFWYGAVC MALPVIRSQN RRNYVAVFAI FVLGGTHAAF
 151 HVQLHNGNLG GLLSGLQSGL VMVSGFIGLI GMRIISFFTS KRLNVPQIPS
 201 PKWVAQASLW LPMLTAILMA HGVMPWLSAA FAFAAGVIFT VQVYRWWYKP
```

-continued
251 VLKEPMLWIL FAGYLFTGLG LIAVGASYFK PAFLNLGVHL IGVGGIGVLT

301 LGMMARTALG HTGNSIYPPP KAVFVAFWLM MAATAVRMVA VFSSGTAYTH

351 SIRTSSVLFA LALLVYAWKY IPWLIRPRSD GRPG*

ORF47ng-1 and ORF47-1 show 97.4% identity in 384 aa overlap:

```
                   10         20         30         40         50         60
    orf47-1.pep    MKFTKHPVWAMAFRPFYSLAALYGALSVLLWGFGYTGTHELSGFYWHAHEMIWGYAGLVV
                   ||||||||||||||||||||||||||||||||||||||||||||||||||||||||||||
    orf47ng-1      MKFTKHPVWAMAFRPFYSLAALYGALSVLLWGFGYTGTHELSGFYWHAHEMIWGYAGLVV
                   10         20         30         40         50         60

70         80         90        100        110        120
    orf47-1.pep    IAFLLTAVATWTGQPPTRGGVLVGLTIFWLAARIAAFIPGWGASASGILGTLFFWYGAVC
                   |||||||||||||||||||||||||||| ||||||||||||||| |||||||||||||||
    orf47ng-1      IAFLLTAVATWTGQPPTRGGVLVGLTAFWLAARIAAFIPGWGAAASGILGTLFFWYGAVC
                   70         80         90        100        110        120

130        140        150        160        170        180
    orf47-1.pep    MALPVIRSQNQRNYVAVFALFVLGGTHAAPHVQLHNGNLGGLLSGLQSGLVMVSGFIGLI
                   ||||||||||:|||||||||:|||||||||||||||||||||||||||||||||||||||
    orf47ng-1      MALPVIRSQNRRNYVAVFAIFVLGGTHAAPHVQLHNGNLGGLLSGLQSGLVMVSGFIGLI
                   130        140        150        160        170        180

190        200        210        220        230        240
    orf47-1.pep    GTRIISFFTSKRLNVPQIPSPKWVAQASLWLPMLTAMLMAHGVLAWLSAVFAFAAGVIFT
                   | |||||||||||||||||||||||||||||||||:||||||||::||:||||||||||
    orf47ng-1      GMRIISFFTSKRLNVPQIPSPKWVAQASLWLPMLTAILMAHGVMPWLSAAFAFAAGVIFT
                   190        200        210        220        230        240

250        260        270        280        290        300
    orf47-1.pep    VQVYRWWYKPVLKEPMLWILFAGYLFTGLGLIAVGASYFKPAFLNLGVHLIGVGGIGVLT
                   ||||||||||||||||||||||||||||||||||||||||||||||||||||||||||||
    orf47ng-1      VQVYRWWYKPVLKEPMLWILFAGYLFTGLGLIAVGASYFKPAFLNLGVHLIGVGGIGVLT
                   250        260        270        280        290        300

310        320        330        340        350        360
    orf47-1.pep    LGMMARTALGHTGNPIYPPPKAVPVAFWLMMAATAVRMVAVFSSGTAYTHSIRTSSVLFA
                   ||||||||||||||| ||||||||||||||||||||||||||||||||||||||||||||
    orf47ng-1      LGMMARTALGHTGNSIYPPPKAVPVAFWLMMAATAVRMVAVFSSGTAYTHSIRTSSVLFA
                   310        320        330        340        350        360

370        380
    orf47-1.pep    LALLVYAWKYIPWLIRPRSDGRPGX
                   |||||||||||||||||||||||||
    orf47ng-1      LALLVYAWKYIPWLIRPRSDGRPGX
                   370        380
```

Furthermore, ORF47ng-1 shows significant homology to an ORF from *Pseudomonas stutzeri*:

```
gnl|PID|e246540 (Z73914) ORF396 protein [Pseudomonas stutzeri] Length = 396
Score = 155 bits (389), Expect = 5e-37
Identities = 121/391 (30%), Positives = 169/391 (42%), Gaps = 21/391 (5%)

Query:   7 PVWAMAFRPFYSLAALYGALSVLLWGFGYTGTHELSGFY-------WHAHEMIWGYAGLV    59
           P+W +AFRPF+   +LY L++ LW +TG    GF       WH HEM++G+A  +
Sbjct:  14 PIWRLAFRPFFLAGSLYALLAIPLWVAAWTGLWP--GFQPTGGWLAWHRHEMLFGFAMAI    71

Query:  60 VIAFLLTAVATWTGQPPTRGGVLVGLTAFWLAARIAAFIPGWGAAASGILGTLFFWYGAV   119
           V  FLLTAV TWTGQ    G  LVGL A WLAAR+ ++ G  AA      L  LF
Sbjct:  72 VAGFLLTAVQTWTGQTAPSGNRLVGLAAVWLAARL-GWLFGLPAAWLAPLDLLFLVALVW   130

Query: 120 CMALPVIRSQNRRNYVAVFAIFVLGGTHAAFXXXXXXXXXXXXXXXXXXXXXXXMVSGFIGL   179
            MA +   + +RNY V +  ++ G                               +V+  + L
Sbjct: 131 MMAQMLWAVRQKRNYPIVVVLSLMLGADVLILTGLLQGNDALQRQGVLAGLWLVAALMAL   190

Query: 180 IGMRIISFFTSKRLNVPQIPSP-KWVAQASLWLPMLTAILMAHG----MPWLSAAFAFA   234
           IG R+I FFT + L      P  W+   A L     + A+L A GV     P L    F  A
Sbjct: 191 IGGRVIPFFTQRGLGKVDAVKPWVWLDVALLVGTGVIALLHAFGVAMRPQPLLGLLFV-A   249

Query: 235 AGVIFTVQVYRWWYKPVLKEPMLWILFAGYLFTGLGLIAVGASYF-KPAFXXXXXXXXXX   293
             GV    +++ RW+ K  K  +LW L    L+ +     +   +F    A
Sbjct: 250 IGVGHLLRLMRWYDKGIWKVGLLWSLHVAMLWLVVAAFGLALWHFGLLAQSSPSLHALSV   309

Query: 294 XXXXXXXXXXMMARTALGHTGNSIYPPPKAVPVAFWLXXXXXXXXXXXXXFSSGTAYTHSIR   353
                     M+AR  LGHTG +  P   +  AF L             F S         +
Sbjct: 310 GSMSGLILAMIARVTLGHTGRPLQLPAGIIG-AFVL---FNLGTAARVFLSVAWPVGGLW   365
```

```
Query: 354 TSSVLFALALLVYAWKYIPWLIRPRSDGRPG            384
            ++V + LA  +Y W+Y P L+  R DG PG
Sbjct: 366 LAAVCWTLAFALYVWRYAPMLVAARVDGHPG            396
```

Based on this analysis, it is predicted that the proteins from *N. meningitidis* and *N. gonorrhoeae*, and their epitopes, could be useful antigens for vaccines or diagnostics, or for raising antibodies.

Example 85

The following partial DNA sequence was identified in *N. meningitidis* <SEQ ID 715>:

```
  1..ATGCCGTCTG AAGGTTCAGA CGGCmTCGGT GyCGGGGAAy CAGAAGyGGT
 51  AGCGCATGCC CAATGAGACT TCGTGGGTTT TGAAGCGGGT GTTTTCCAAG
101  CGTCCCCAGT TGTGGTAACG GTATCCGGTG TCyAArGTCA GCTTGGGyGT
151  GATGTCGAAa CCGACACCGG CGATGACACC AAGACCyAmG CTGCTGATrC
201  TGTkGCTTTC GTGATAGGsA GGTTTCyTGG kmksAsyTTG TAyrATwkkG
251  CCTssCwsTG kAGmGCCkTk CkyTGGTkkA swGrwArTAG TCGTGGTTTy
301  TkTTyyCACC GAATGAACyT GATGTTTAAC GTGTCCGTAG GCGACGCGCG
351  CGCCGATATA GGGTTTGAAT TTATCGTTGA GTTTGAAATC GTAAATGGCG
401  GACAAGCCGA GAGAAGAAAC GGCGTGGAAG CTGCCGTTTC CCTGATGTTT
451  TGTTTGGGTT TCTTTGTAGT TGTTGTTTAT CTCTTCAGTA ACTTTTTTAG
501  TAGAAGAATT ACTTTCTTTC CATTTTCTGT AACTGGCATA ATCTGCCGCT
551  ATTCTCCAGC CGCCGAAATC ..
```

This corresponds to the amino acid sequence <SEQ ID 716; ORF67>:

```
  1..MPSEGSDGXG XGEXEXVAHA QXDFVGFEAG VFQASPVVVT VSGVXXQLGX
 51  DVETDTGDDT KTXAADXVAF VIGRFXGXXL YXXAXXXXAX XWXXXXSRGF
101  XXHRMNLMFN VSVGDARADI GFEFIVEFEI VNGGQAERRN GVEAAVSLMF
151  CLGFFVVVVY LFSNFFSRRI TFFPFSVTGI ICRYSPAAEI ..
```

Computer analysis of this amino acid sequence gave the following results:

Homology with a Predicted ORF from *N. gonorrhoeae*

ORF67 shows 51.8% identity over 199 aa overlap with a predicted ORF (ORF67ng) from *N. gonorrhoeae*:

```
orf67.pep                                    MPSEGSDGXGXGEXEXVAHAQXDFVGFEAG    30
                                             |||||||| | ||| |||||  ||||||||
orf67ng    TNFEIAVLSGMTVRVFYCARPAPVNGGRLKMPSEGSDGIGIGESEAVAHAQRGFVGFEAG   146
                   90        100       110       120       130       140
orf67.pep  VFQASPVVVTVSGVXXQLGXDVETDTGDDTKTXAADXVAFVIGRFXGXXLYXXAXXXXAX    90
           ||||||||  :||     |  | :    :::  ||    ||||:||        :      :
orf67ng    VFQASPVVVAVAGVQGQAGRDVYAHARHRAEAQAAAAVAPLIGVFLRMSVRINRNCCVSI   206
orf67.pep  XWXXXXSRGFXXHRMNLMFNVSVGDARADIGFEFIVEFEIVNGGQAERRNGVEAAVSLMF   150
            |    |  | :||||||||||||||| | ||||| |||||||||||||||||| | |||
orf67ng    TRVGGKSTCYFFSRIDAVSDVSVGDARTDIGFEFVVEFEIVNGGQAERRNGVECAVFLMF   266
orf67.pep  CLGFFVV--------VVYLFSNFFSRRITFF-PFSVTGIICRYSPAAEI             190
            :: | : : | |   :|||||    :||||
orf67ng    RLLVFYVKLVAAKSFIILSFQLFYVHGIFIVVPFPVTGIIRGDAPAAEVVADRHPGVDGM   326
```

The ORF67ng nucleotide sequence <SEQ ID 717> is predicted to encode a protein comprising amino acid sequence <SEQ ID 718>:

```
  1 MPSETVGSIV NVGVDESVGF SPPFPSIQHF YRFHRIHRIR LFRPPGPMQL

51 NRHSHGSGNL GRGVWATVLS DKFPCGQVRI PACAGMTNFE IAVLSGMTVR

101 VFYCARPAPV NGGRLKMPSE GSDGIGIGES EAVAHAQRGF VGFEAGVFQA

151 SPVVVAVAGV QGQAGRDVYA HARHRAEAQA AAAVAFLIGV FLRMSVRINR

201 NCCVSITRVG GKSTCYFFSR IDAVSDVSVG DARTDIGFEF VVEFEIVNGG

251 QAERRNGVEC AVFLMFRLLV FYVKLVAAKS FIILSFQLFY VHGIFIVVPF

301 PVTGIIRGDA PAAEVVADRH PGVDGMRTDV SEIIAYRAYF VFAWSGWFRI

351 IVGNAFGGVG *
```

Based on the presence of a several putative transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 86

The following partial DNA sequence was identified in *N. meningitidis* <SEQ ID 719>

```
  1 ATGTTTGCTT TTTTAGAAGC CTTTTTTGTC GAATACGGTT
    ATGCGGCTGT

51 TTTTTTTGTA TTGGTCATCT GCGGTTTCGG CGTGCCGATT
    CCCGAGGATT

101 TGACCTTGGT AACAGGCGGC GTGATTTCGG GTATGGGTTA
    TACCAATCCG

151 CATATTATGT TTGCAGTCGG TATGCTCGGC GTATTGGTCG
    GGGACGGCAT

201 CATGTTCGCC GCCGGACGAA TTTGGGGGCA GArArTCCTA
    rGGTTCArAC

251 CTATTGCGsG CATCATGACG CCGrAACGTT ATGAGCAGGT
    TCAGGAAAAA

301 TTCGACAAAT ACGGTAACTG GGTCTTATTT GTCGCCCGTT
    TCCTGCCCGG

351 TTTGAGAACG GCCGTATTTG TTACAGCCGG TATCAGCCGC
    AAGGTTTCAT

401 ACTTGCGTTT TATCATTATG GATGGACTGG CCGCA...
```

This corresponds to the amino acid sequence <SEQ ID 720; ORF78>:

```
  1 MFAFLEAFFV EYGYAAVFFV LVICGFGVPI PEDLTLVTGG
    VISGMGYTNP

51 HIMFAVGMLG VLVGDGIMFA AGRIWGQXXL XFXPIAXIMT
    PXRYEQVQEK

101 FDKYGNWVLF VARFLPGLRT AVFVTAGISR KVSYLRFIIM
    DGLAA...
```

Further work revealed the complete nucleotide sequence <SEQ ID 721>:

```
  1 ATGTTTGCTT TTTTAGAAGC CTTTTTTGTC GAATACGGTT
    ATGCGGCTGT

51 TTTTTTTGTA TTGGTCATCT GCGGTTTCGG CGTGCCGATT
    CCCGAGGATT

101 TGACCTTGGT AACAGGCGGC GTGATTTCGG GTATGGGTTA
    TACCAATCCG

151 CATATTATGT TTGCAGTCGG TATGCTCGGC GTATTGGTCG
    GGGACGGCAT

201 CATGTTCGCC GCCGGACGAA TTTGGGGGCA GAAAATCCTA
    AGGTTCAAAC

251 CTATTGCGCG CATCATGACG CCGAAACGTT ATGAGCAGGT
    TCAGGAAAAA

301 TTCGACAAAT ACGGTAACTG GGTCTTATTT GTCGCCCGTT
    TCCTGCCCGG

351 TTTGAGAACG GCCGTATTTG TTACAGCCGG TATCAGCCGC
    AAGGTTTCAT

401 ACTTGCGTTT TATCATTATG GATGGACTGG CCGCACTGAT
    TTCCGTCCCT

451 ATTTGGATTT ATCTGGGCGA ATACGGTGCG CACAACATCG
    ATTGGCTGAT

501 GGCGAAAATG CACAGCCTGC AATCGGGTAT TTTTGTTATC
    TTGGGTATAG

551 GTGCGACCGT TGTCGCTTGG ATTTGGTGGA AAAAACGCCA
    ACGTATCCAG

601 TTTTACCGCA GCAAATTGAA AGAAAAGCGG GCGCAACGCA
    AAGCCGCCAA

651 GGCAGCCAAA AAAGCCGCGC AAAGCAAACA ATAA
```

This corresponds to the amino acid sequence <SEQ ID 722; ORF78-1>:

```
  1 MFAFLEAFFV EYGYAAVFFV LVICGFGVPI PEDLTLVTGG
    VISGMGYTNP

51 HIMFAVGMLG VLVGDGIMFA AGRIWGQKIL RFKPIARIMT
    PKRYEQVQEK

101 FDKYGNWVLF VARFLPGLRT AVFVTAGISR KVSYLRFIIM
    DGLAALISVP
```

```
151 IWIYLGEYGA HNIDWLMAKM HSLQSGIFVI LGIGATVVAW
    IWWKKRQRIQ

201 FYRSKLKEKR AQRKAAKAAK KAAQSKQ*
```

Computer analysis of this amino acid sequence predicts several transmembrane domains, and also gave the following results:

Homology with the dedA Homologue of *H. influenzae* (Accession Number P45280)

ORF78 and the dedA homologue show 58% aa identity in 144aa overlap:

```
Orf78:    4 FLEAFFVEYGYAAVFFVLVICGFGVPIPEDLTLVTGGVISGM--GYTNPHIMFAVGMLGV    61
            FL  FF EYGY AV FVL+ICGFGVPIPED+TLV+GGVI+G+    N H+M  V M+GV
DedA:    20 FLIGFFTEYGYWAVLFVLIICGFGVPIPEDITLVSGGVIAGLYPENVNSHLMLLVSMIGV    79

Orf78:   62 LVGDGIMFAAGRIWGQXXLXFXPIAXIMTPXRYEQVQEKFDKYGNWVLFVARFLPGLRTA   121
            L GD M+  GRI+G   L F PI I+T R   V+EKF +YGN VLFVARFLPGLR
DedA:    80 LAGDSCMYWLGRIYGTKILRFRPIRRIVTLQRLRMVREKFSQYGNRVLFVARFLPGLRAP   139

Orf78:  122 VFVTAGISRKVSYLRFIIMDGLAA                                       145
             +++ +GI+R+VSY+RF+++D AA
DedA:   140 IYMVSGITRRVSYVRFVLIDFCAA                                       163
```

Homology with a Predicted ORF from *N. meningitidis* (Strain A)

ORF78 shows 93.8% identity over a 145aa overlap with an ORF (ORF78a) from strain A of *N. meningitidis*:

```
                     10         20         30         40         50         60
orf78.pep   MFAFLEAFFVEYGYAAVFFVLVICGFGVPIPEDLTLVTGGVISGMGYTNPHIMFAVGMLG
            |||:||||||||||||||||||||||||||||||||||||||||||||||||||||||||
orf78a      MFALLEAFFVEYGYAAVFFVLVICGFGVPIPEDLTLVTGGVISGMGYTNPHIMFAVGMLG
                     10         20         30         40         50         60

70         80         90        100        110        120
orf78.pep   VLVGDGIMFAAGRIWGQXXLXFXPIAXIMTPXRYEQVQEKFDKYGNWVLFVARFLPGLRT
            |||||||||||||||||  |  ||| |||| ||||||||||||||||||||||||||||
orf78a      VLVGDGIMFAAGRIWGQKILKFKPIARIMTPKRYAQVQEKFDKYGNWVLFVARFLPGLRT
                     70         80         90        100        110        120

130        140
orf78.pep   AVFVTAGISRKVSYLRFIIMDGLAA
            |||||||||||||||||:|||||||
orf78a      AVFVTAGISRKVSYLRFLIMDGLAALISVPVWIYLGEYGAHNIDWLMAKMHSLQSGIFIA
                    130        140        150        160        170        180
```

The complete length ORF78a nucleotide sequence <SEQ ID 723> is:

```
  1 ATGTTTGCCC TTTTGGAAGC CTTTTTTGTC GAATACGGCT
    ATGCGGCCGT

51 GTTTTTCGTT TTGGTCATCT GCGGTTTCGG CGTGCCGATT
    CCCGAGGATT

101 TGACCTTGGT AACAGGCGGC GTGATTTCGG GTATGGGTTA
    TACCAATCCG

151 CATATTATGT TTGCAGTCGG TATGCTCGGC GTATTGGTCG
    GGGACGGCAT

201 CATGTTCGCC GCCGGACGCA TCTGGGGGCA GAAAATCCTC
    AAGTTCAAAC

251 CGATTGCGCG CATCATGACG CCGAAACGTT ACGCACAGGT
    TCAGGAAAAA

301 TTCGACAAAT ACGGCAACTG GGTGTTATTT GTCGCTCGTT
    TCCTGCCCGG

351 TTTGCGGACT GCCGTTTTCG TTACCGCCGG CATCAGCCGC
    AAAGTATCGT

401 ATCTGCGCTT TCTGATTATG GACGGGCTTG CCGCGCTGAT
    TTCCGTGCCC

451 GTTTGGATTT ACTTGGGCGA GTACGGCGCG CACAACATCG
    ATTGGCTGAT

501 GGCGAAAATG CACAGCCTGC AATCCGGCAT CTTCATCGCA
    TTGGGCGTGC

551 TGGCGGCGGC GCTGGCGTGG TTCTGGTGGC GCAAACGCCG
    ACATTATCAG

601 CTTTACCGCG CACAATTGAG CGAAAAACGC GCCAAACGCA
    AGGCGGAAAA

651 GGCAGCGAAA AAAGCGGCAC AGAAGCAGCA GTAA
```

This encodes a protein having amino acid sequence <SEQ ID 724>:

```
  1 MFALLEAFFV EYGYAAVFFV LVICGFGVPI PEDLTLVTGG
    VISGMGYTNP

51 HIMFAVGMLG VLVGDGIMFA AGRIWGQKIL KFKPIARIMT
    PKRYAQVQEK
```

-continued

```
101 FDKYGNWVLF VARFLPGLRT AVFVTAGISR KVSYLRFLIM
    DGLAALISVP

151 VWIYLGEYGA HNIDWLMAKM HSLQSGIFIA LGVLAAALAW
    FWWRKRRHYQ

201 LYRAQLSEKR AKRKAEKAAK KAAQKQQ*
```

ORF78a and ORF78-1 show 89.0% identity in 227 aa overlap:

```
                    10         20         30         40         50         60
orf78a.pep  MFALLEAFFVEYGYAAVFFVLVICGFGVPIPEDLTLVTGGVISGMGYTNPHIMFAVGMLG
            |||:||||||||||||||||||||||||||||||||||||||||||||||||||||||||
orf78-1     MFAFLEAFFVEYGYAAVFFVLVICGFGVPIPEDLTLVTGGVISGMGYTNPHIMFAVGMLG
                    10         20         30         40         50         60

70         80         90        100        110        120
orf78a.pep  VLVGDGIMFAAGRIWGQKILKFKPIARIMTPKRYAQVQEKFDKYGNWVLFVARFLPGLRT
            ||||||||||||||||||||:|||||||||||||||:||||||||||||||||||||||
orf78-1     VLVGDGIMFAAGRIWGQKILRFKPIARIMTPKRYEQVQEKFDKYGNWVLFVARFLPGLRT
                    70         80         90        100        110        120

130        140        150        160        170        180
orf78a.pep  AVFVTAGISRKVSYLRFLIMDGLAALISVPVWIYLGEYGAHNIDWLMAKMHSLQSGIFIA
            |||||||||||||||||:|||||||||||||:||||||||||||||||||||||||||:
orf78-1     AVFVTAGISRKVSYLRFIIMDGLAALISVPIWIYLGEYGAHNIDWLMAKMHSLQSGIFVI
                   130        140        150        160        170        180

190        200        210        220
orf78a.pep  LGVLAAALAWFWWRKRRHYQLYRAQLSEKRAKRKAEKAAKKAAQKQQX
            ||: |:::||:||:||:: |:||::|:||||:||| ||||||||::||
orf78-1     LGIGATVVAWIWWKKRQRIQFYRSKLKEKRAQRKAAKAAKKAAQSKQX
                   190        200        210        220
```

Homology with a Predicted ORF from *N. gonorrhoeae*

ORF78 shows 97.4% identity over 38 aa overlap with a predicted ORF (ORF78ng) from *N. gonorrhoeae*:

```
orf78.pep   XXLXFXPIAXIMTPXRYEQVQEKFDKYGNWVLFVARFLPGLRTAVFVTAGISRKVSYLRF  137
                             |||||||||||||||||||||||||||||||
orf78ng                      YPVLFVARFLPGLRTAVFVTAGISRKVSYLRF   32 orf78.pep   IIMDGLAA                                                      145
            :|||||||
orf78ng     LIMDGLAALISVPVWIYLGEYGAHNIDWLMAKMHSLQSGIFIALGVLAAALAWFWWRKRR   92
```

The ORF78ng nucleotide sequence <SEQ ID 725> is predicted to encode a protein comprising amino acid sequence <SEQ ID 726>:

```
  1 ...YPVLFVARFL PGLRTAVFVT AGISRKVSYL RFLIMDGLAA
     LISVPVWIYL

51    GEYGAHNIDW LMAKNHSLQS GIFIALGVLA AALAWFWWRK
       RRHYQLYRAQ

101    LSEKRAKRKA EKAAKKAAQK QQ*
```

Further work revealed the complete gonococcal nucleotide sequence <SEQ ID 727>:

```
  1 atgtttgccc tttTggaagc CTTTTTTGTC GAAtacggCt
    atgcGGCCGT

51 GTTTTTCGTT TTGGTCATCT GCGGTTTCGG CGTGCCGATT
    CCCGAAGATT

101 TGACCTTGGT AACGGGCGGC GTGATTTCGG GTATGGGTTA
    TACCAATCCG
```

-continued

```
151 CATATTATGT TTGCGGTCGG TATGCTCGGC GTGTTGGCGG
    GCGACGGCGT

201 GATGTTTGCC GCCGGACGCA TCTGGGGGCA GAAAATCCTC
    AAGTTCAAAC

251 CGATTGCGCG CATCATGACG CCGAAACGTT ACGCGCAGGT
    TCAGGAAAAA

301 TTCGACAAAT ACGGCAACTG GGTTCTGTTT GTCGCCCGTT
    TCCTGCCGGG

351 TTTGCGGACT GCCGTTTTCG TTACCGCCGG CATCAGCCGC
    AAAGTATCGT

401 ATCTGCGCTT TCTGATTATG GACGGGCTGG CCGCGCTGAT
    TTCCGTGCCC

451 GTTTGGATTT ACTTGGGCGA GTACGGCGCG CACAACATCG
    ATTGGCTGAT

501 GGCGAAAATG CACAGCCTGC AATCGGGCAT CTTCATCGCA
    TTGGGCGTGC

551 TGGCGGCGGC GCTGGCGTGG TTCTGGTGGC GCAAACGCCG
    ACATTATCAG

601 CTTTACCGCG CACAATTGAG CGAAAAACGC GCCAAACGCA
    AGGCGGAAAA

651 GGCAGCGAAA AAAGCGGCAC AGAAGCAGCA GTAa
```

This corresponds to the amino acid sequence <SEQ ID 728; ORF78ng-1>:

```
  1 MFALLEAFFV EYGYAAVFFV LVICGFGVPI PEDLTLVTGG
    VISGMGYTNP

51 HIMFAVGMLG VLAGDGVMFA AGRIWGQKIL KFKPIARIMT
    PKRYAQVQEK

101 FDKYGNWVLF VARFLPGLRT AVFVTAGISR KVSYLRFLIM
    DGLAALISVP

151 VWIYLGEYGA HNIDWLMAKM HSLQSGIFIA LGVLAAALAW
    FWWRKRRHYQ

201 LYRAQLSEKR AKRKAEKAAK KAAQKQQ*
```

ORF78ng-1 and ORF78-1 show 88.1% identity in 227 aa overlap:

Based on this analysis, including the presence of putative transmembrane domains, it is predicted that these proteins from N. meningitidis and N. gonorrhoeae, and their epitopes, could be useful antigens for vaccines or diagnostics, or for raising antibodies.

Example 87

The following partial DNA sequence was identified in N. meningitidis <SEQ ID 729>:

```
  1 ATGAAAAAAT TATTGGCGGC CGTGATGATG GCAGGTTTGG
    CAGGCGCGGT

51 TTCCGCCGCC GGAGTCCACG TTGAGGACGG CTGGGCGCGC
    ACCACCGTCG
```

```
                     10         20         30         40         50         60
    orf78-1.pep  MFAFLEAFFVEYGYAAVFFVLVICGFGVPIPEDLTLVTGGVISGMGYTNPHIMFAVGMLG
                 |||:||||||||||||||||||||||||||||||||||||||||||||||||||||||||
    orf78ng-1    MFALLEAFFVEYGYAAVFFVLVICGFGVPIPEDLTLVTGGVISGMGYTNPHIMFAVGMLG
                     10         20         30         40         50         60

70         80         90        100        110        120
    orf78-1.pep  VLVGDGIMFAAGRIWGQKILRFKPIARIMTPKRYEQVQEKFDKYGNWVLFVARFLPGLRT
                 ||:|||:||||||||||||||:||||||||||||| ||||||||||||||||||||||||
    orf78ng-1    VLAGDGVMFAAGRIWGQKILKFKPIARIMTPKRYAQVQEKFDKYGNWVLFVARFLPGLRT
                     70         80         90        100        110        120

130        140        150        160        170        180
    orf78-1.pep  AVFVTAGISRKVSYLRFIIMDGLAALISVPIWIYLGEYGAHNIDWLMAKMHSLQSGIFVI
                 ||||||||||||||||||:|||||||||||:|||||||||||||||||||||||||||||:
    orf78ng-1    AVFVTAGISRKVSYLRFLIMDGLAALISVPVWIYLGEYGAHNIDWLMAKMHSLQSGIFIA
                    130        140        150        160        170        180

190        200        210        220
    orf78-1.pep  LGIGATVVAWIWWKKRQRIQFYRSKLKEKRAQRKAAKAAKKAAQSKQX
                 ||:  |:::||:||:|::  |:||::||||||:|||  |||||||:||
    orf78ng-1    LGVLAAALAWFWWRKRRHYQLYRAQLSEKRAKRKAEKAAKKAAQKQQX
                    190        200        210        220
```

Furthermore, orf78ng-1 shows homology to the dedA protein from H. influenzae:

```
sp|P45280|YG29_HAEIN HYPOTHETICAL PROTEIN HI1629 > gi|1073983|pir||D64133 dedA
protein (dedA) homolog - Haemophilus influenzae (strain Rd KW20)
>gi|1574476 (U32836) dedA protein (dedA) [Haemophilus influenzae] Length = 212
 Score = 223 bits (563), Expect = 7e - 58
 Identities = 108/182 (59%), Positives = 140/182 (76%), Gaps = 2/182 (1%)

Query:    5 LEAFFVEYGYAAVFFVLVICGFGVPIPEDLTLVTGGVISGM--GYTNPHIMFAVGMLGVL    62
            L  FF EYGY AV FVL+ICGFGVPIPED+TLV+GGVI+G+      N H+M V M+GVL
Sbjct:   21 LIGFFTEYGYWAVLFVLIICGFGVPIPEDITLVSGGVIAGLYPENVNSHLMLLVSMIGVL    80

Query:   63 AGDGVMFAAGRIWGQKILKFKPIARIMTPKRYAQVQEKFDKYGNWVLFVARFLPGLRTAV   122
            AGD M+  GRI+G KIL+F+PI RI+T +R   V+EKF +YGN VLFVARFLPGLR  +
Sbjct:   81 AGDSCMYWLGRIYGTKILRFRPIRRIVTLQRLRMVREKFSQYGNRVLFVARFLPGLRAPI   140

Query:  123 FVTAGISRKVSYLRFLIMDGLAALISVPVWIYLGEYGAHNIDWLMAKMHSLQSGIFIALG   182
             + +GI+R+VSY+RF+++D  AA+ISVP+WIYLGE GA N+DWL ++   Q  I+I +G
Sbjct:  141 YMVSGITRRVSYVRFVLIDFCAAIISVPIWIYLGELGAKNLDWLHTQIQKGQIVIYIFIG   200

Query:  183 VL                                                             184
            L
Sbjct:  201 YL                                                             202
```

-continued

```
101 AAGGTATGAA AATAGGCGGC GCGTTCATGA AAATCCACAA
    CGACGAAGCC

151 AAACAAGACT TTTTGCTCGG CGGAAGCAGC CCCGTTGCCG
    ACCGCGTCGA

201 AGTGCATACC CACATCAACG ACAACGGCGT GATGCGGATG
    CGCGAAGTCG

251 AACGCCGCGT GCCTTTGGAA GCGAAATCCG TTACCGAACT
    CAAACCCGGC

301 AGCTATCATG TGATGTTTAT GGGTTTGAAA AACAATTAA
    AAGAGGGCGA

351 TAAAATTCCC GTTACCCTGA AATTTAAAAA CGCCAAAGCG
    CAAACCGTCC

401 AACTGGAAGT CAAAATCGCG CCGATGCCGG CAATGAACCA
    C . . .
```

This corresponds to the amino acid sequence <SEQ ID 730; ORF79>:

```
  1 MKKLLAAVMM AGLAGAVSAA GVHVEDGWAR TTVEGMKIGG
    AFMKIHNDEA

51 KQDFLLGGSS PVADRVEVHT HINDNGVMRM REVEGGVPLE
    AKSVTELKPG

101 SYHVMFMGLK KQLKEGDKIP VTLKFKNAKA QTVQLEVKIA
    PMPANNH . . .
```

Further work revealed the complete nucleotide sequence <SEQ ID 731>:

```
  1 ATGAAAAAAT TATTGGCGGC CGTGATGATG GCAGGTTTGG
    CAGGCGCGGT

51 TTCCGCCGCC GGAGTCCACG TTGAGGACGG CTGGGCGCGC
    ACCACCGTCG

101 AAGGTATGAA AATAGGCGGC GCGTTCATGA AAATCCACAA
    CGACGAAGCC

151 AAACAAGACT TTTTGCTCGG CGGAAGCAGC CCCGTTGCCG
    ACCGCGTCGA

201 AGTGCATACC CACATCAACG ACAACGGCGT GATGCGGATG
    CGCGAAGTCG

251 AAGGCGGCGT GCCTTTGGAA GCGAAATCCG TTACCGAACT
    CAAACCCGGC
```

-continued

```
301 AGCTATCATG TGATGTTTAT GGGTTTGAAA AACAATTAA
    AAGAGGGCGA

351 TAAAATTCCC GTTACCCTGA AATTTAAAAA CGCCAAAGCG
    CAAACCGTCC

401 AACTGGAAGT CAAAATCGCG CCGATGCCGG CAATGAACCA
    CGGTCATCAC

451 CACGGCGAAG CGCATCAGCA CTAA
```

This corresponds to the amino acid sequence <SEQ ID 732; ORF79-1>:

```
  1 MKKLLAAVMM AGLAGAVSAA GVHVEDGWAR TTVEGMKIGG
    AFMKIHNDEA

51 KQDFLLGGSS PVADRVEVHT HINDNGVMRM REVEGGVPLE
    AKSVTELKPG

101 SYHVMFMGLK KQLKEGDKIP VTLKFKNAKA QTVQLEVKIA
    PMPAMNHGHH

151 HGEAHQH*
```

Computer analysis of this amino acid sequence revealed a putative leader peptide and also gave the following results:

Homology with a Predicted ORF from *N. meningitidis* (Strain A)

ORF79 shows 94.6% identity over a 147aa overlap with an ORF (ORF79a) from strain A of *N. meningitidis*:

```
                      10         20         30         40         50         60
orf79.pep    MKKLLAAVMMAGLAGAVSAAGVHVEDGWARTTVEGMKIGGAFMKIHNDEAKQDFLLGGSS
             || |||||||||||||||||:||||||||||||||||:|||||||||||||||||||||
orf79a       MKXLLAAVMMAGLAGAVSAAGIHVEDGWARTTVEGMKMGGAFMKIHNDEAKQDFLLGGSS
                      10         20         30         40         50         60

70         80         90        100        110        120
orf79.pep    PVADRVEVHTHINDNGVMRMREVEGGVPLEAKSVTELKPGSYHVMFMGLKKQLKEGDKIP
             ||||||||||||||||||||||||||||||||||||||||||||||||| |||| |||||
orf79a       PVADRVEVHTHINDNGVMRMREVEGGVPLEAKSVTELKPGSYHVMFMGXKKQLKXGDKIP
                      70         80         90        100        110        120

130        140
orf79.pep    VTLKFKNAKAQTVQLEVKIAPMPAMNH
             |||||||||||||||||||  || ||:|
orf79a       VTLKFKNAKAQTVQLEVKTAPMSAMDHGHHHGEAHQHX
                     130        140        150
```

The complete length ORF79a nucleotide sequence <SEQ ID 733> is:

```
  1 ATGAAANAAC TATTGGCAGC CGTGATGATG GCAGGTTTGG
    CAGGCGCGGT

51 TTCCGCCGCC GGAATCCACG TTGAGGACGG CTGGGCGCGC
    ACCACCGTCG

101 AAGGTATGAA AATGGGCGGC GCGTTCATGA AAATCCACAA
    CGACGAAGCC

151 AAACAAGACT TTTTGCTCGG CGGAAGCAGC CCTGTTGCCG
    ACCGCGTCGA

201 AGTGCATACC CATATCAATG ATAACGGTGT GATGCGGATG
    CGCGAAGTCG
```

```
251 AAGGCGGCGT GCCTTTGGAG GCGAAATCCG TTACCGAACT
    CAAACCCGGC

301 AGCTATCATG TCATGTTTAT GGGTNTGAAA AACAATTAA
    AAGANGGCGA

351 CAAGATTCCC GTTACCCTGA AATTTAAAAA CGCCAAAGCA
    CAAACCGTCC

401 AACTGGAAGT CAAAACCGCG CCGATGTCGG CAATGGACCA
    CGGTCATCAC

451 CACGGCGAAG CGCATCAGCA CTAA
```

This encodes a protein having amino acid sequence <SEQ ID 734>:

```
  1 MKXLLAAVMM AGLAGAVSAA GIHVEDGWAR TTVEGMKMGG
    AFMKIHNDEA

51 KQDFLLGGSS PVADRVEVHT HINDNGVMRM REVEGGVPLE
    AKSVTELKPG

101 SYHVMFMGXK KQLKXGDKIP VTLKFKNAKA QTVQLEVKTA
    PMSAMDHGHH

151 HGEAHQH*
```

ORF79a and ORF79-1 show 94.9% identity in 157 aa overlap:

```
                    10         20         30         40         50         60
orf79a.pep  MKXLLAAVMMAGLAGAVSAAGIHVEDGWARTTVEGMKMGGAFMKIHNDEAKQDFLLGGSS
            ||  |||||||||||||||||:||||||||||||||||:||||||||||||||||||||
orf79-1     MKKLLAAVMMAGLAGAVSAAGVHVEDGWARTTVEGMKIGGAFMKIHNDEAKQDFLLGGSS
                    10         20         30         40         50         60
                    70         80         90        100        110        120
orf79a.pep  PVADRVEVHTHINDNGVMRMREVEGGVPLEAKSVTELKPGSYHVMFMGXKKQLKXGDKIP
            ||||||||||||||||||||||||||||||||||||||||||||||||| |||| |||||
orf79-1     PVADRVEVHTHINDNGVMRMREVEGGVPLEAKSVTELKPGSYHVMFMGLKKQLKEGDKIP
                    70         80         90        100        110        120
                   130        140        150
orf79a.pep  VTLKFKNAKAQTVQLEVKTAPMSAMDHGHHHGEAHQHX
            |||||||||||||||||||  ||  :||||||||||||
orf79-1     VTLKFKNAKAQTVQLEVKIAPMPAMNHGHHHGEAHQHX
                   130        140        150
```

Homology with a Predicted ORF from *N. gonorrhoeae*
ORF79 shows 96.1% identity over 76 aa overlap with a predicted ORF (ORF79ng) from *N. gonorrhoeae*:

```
orf79.pep   FMKIHNDEAKQDFLLGGSSPVADRVEVNTHINDNGVMRMREVEGGVPLEAKSVTELKPGS  101
                                    |||||||||:||||||||||||||||||||||
orf79ng                             INDNGVMRMREVKGGVPLEAKSVTELKPGS    30
orf79.pep   YHVMFMGLKKQLKEGDKIPVTLKFKNAKAQTVQLEVKIAPMPAMNH               147
            |||||||||||||||||||||||||||||||||||||| ||| ||||
orf79ng     YHVMFMGLKKQLKEGDKIPVTLKFKNAKAQTVQLEVKTAPMSAMNHGHHHGEAHQH      86
```

An ORF79ng nucleotide sequence <SEQ ID 735> was predicted to encode a protein comprising amino acid sequence <SEQ ID 736>:

```
  1 . . . . INDNGVMRNR EVKGGVPLEA KSVTELKPGS
    YHVMFMGLKK QLKEGDKIPV

51 TLKFKNAKAQ TVQLEVKTAP MSAMNHGHHH GEAHQH*
```

Further work revealed the complete gonococcal DNA sequence <SEQ ID 737>:

```
  1 ATGAAAAAAT TATTGGCAGC CGTGATGATG GCAGGTTTGG
    CAGGCGCGGT

51 TTccgccgCc GGagTccAtG TCGAggACGG CTGGGCGCGc
    accaCTGtcg 101 aaggtATgaa aatggGCGGC GCgttCATga aaATCCACAA
    CGACGaaGcc 151 atacaaGACt ttgtgcTCgg CGGaagcatg cccgttgccg
    accgcGTCGA 201 AGTGCAtaca cacATCAACG ACAACGGCGT GATGCGTATG
    CGCGAAGTCA

251 AAGGCGGCGT GCCTTTGGAG GCGAAATCCG TTACCGAACT
    CAAACCCGGC

301 AGCTATCACG TGATGTTTAT GGGTTTGAAA AACAACTGA
    AAGAGGGCGA

351 CAAGATTCCC GTTACCCTGA AATTTAAAAA CGCCAAAGCG
    CAAACCGTCC

401 AACTGGAAGT CAAAACCGCG CCGATGTCGG CAATGAACCA
    CGGTCATCAC

451 CACGGCGAAG CGCATCAGCA CTAA
```

This corresponds to the amino acid sequence <SEQ ID 738; ORF79ng-1>:

```
  1 MKKLLAAVMM AGLAGAVSAA GVHVEDGWAR TTVEGMKMGG
    AFMKIHNDEA

51 IQDFVLGGSM PVADRVEVHT HINDNGVMRM REVKGGVPLE
    AKSVTELKPG

101 SYHVMFMGLK KQLKEGDKIP VTLKFKNAKA QTVQLEVKTA
    PMSAMNHGHH

151 HGEAHQH*
```

ORF79ng-1 and ORF79-1 show 95.5% identity in 157 aa overlap:

```
                  10        20        30        40        50        60
orf79-1.pep  MKKLLAAVMMAGLAGAVSAAGVHVEDGWARTTVEGMKIGGAFMKIHNDEAKQDFLLGGSS
             |||||||||||||||||||||||||||||||||||:||||||||||||| :|||
orf79ng-1    MKKLLAAVMMAGLAGAVSAAGVHVEDGWARTTVEGMKMGGAFMKIHNDEAIQDFVLGGSM
                  10        20        30        40        50        60
                  70        80        90       100       110       120
orf79-1.pep  PVADRVEVHTHINDNGVMRMREVEGGVPLEAKSVTELKPGSYHVMFMGLKKQLKEGDKIP
             |||||||||||||||||||||||:|||||||||||||||||||||||||||||||||||
orf79ng-1    PVADRVEVHTHINDNGVMRMREVKGGVPLEAKSVTELKPGSYHVMFMGLKKQLKEGDKIP
                  70        80        90       100       110       120
                 130       140       150
orf79-1.pep  VTLKFKNAKAQTVQLEVKIAPMPAMNHGHHHGEAHQHX
             ||||||||||||||||||| |||||||||||||||||
orf79ng-1    VTLKFKNAKAQTVQLEVKTAPMSAMNHGHHHGEAHQHX
                 130       140       150
```

Furthermore, ORF79ng-1 shows significant homology to a protein from *Aquifex aeolicus*:

```
gi|2983695 (AE000731) putative protein [Aquifex aeolicus] Length = 151
Score = 63.6 bits (152), Expect = 6e-10
Identities = 38/114 (33%), Positives = 58/114 (50%), Gaps = 1/114 (0%)

Query:  24 VEDGWARTTVEGMKMGGAFMKIHNDEAIQDFVLGGSMPVADRVEVHTHINDNGVMRMREV   83
              V+ W       G     M I N+     D+++G   +A RVE+H   + +N V +M
Sbjct:  27 VKHPWVMEPPPGPNTTMMGMIIVNEGDEPDYLIGAKTDIAQRVELHKTVIENDVAKMVPQ   86

Query:  84 KGGVPLEAKSVTELKPGSYHVMFMGLKKQLKEGDKIPVTLKFKNAKAQTVQLEV        137
              +  + +  K    E K     YHVM +GLKK++KEGDK+ V L F+ +    TV+ V
Sbjct:  87 ER-IEIPPKGKVEFKHHGYHVMIIGLKKRIKEGDKVKVELIFEKSGKITVEAPV        139
```

Based on this analysis, it is predicted that the proteins from *N. meningitidis* and *N. gonorrhoeae*, and their epitopes, could be useful antigens for vaccines or diagnostics, or for raising antibodies.

ORF79-1 (15.6 kDa) was cloned in the pET vector and expressed in *E. coli*, as described above. The products of protein expression and purification were analyzed by SDS-PAGE. FIG. 18A shows the results of affinity purification of the His-fusion protein. Purified His-fusion protein was used to immunise mice, whose sera were used for ELISA (positive result) and FACS analysis (FIG. 18B) These experiments confirm that ORF79-1 is a surface-exposed protein, and that it is a useful immunogen.

Example 88

The following DNA sequence, believed to be complete, was identified in *N. meningitidis* <SEQ ID 739>:

```
  1 ATGACGGTAA CTGCGGCCGA AGGCGGCAAA GCTGCCAAGG
    CGTTAAAAAA
 51 ATATCTGATT ACGGGCATTT TGGTCTGGCT GCCGATTGCG
    GTAACGGTTT
101 GGGTGGTTTC CTATATCGTT TCCGCGTCCG ATCACGTCGT
    CAACCTGCTG
151 CCGAAGCAAT GGCGGCCGCA ATATGTTTTG GGGTTTAATA
    TCCCGGGGCT
201 GGCCGTTATC GTTGCCATTG CCGTATTGTT TGTAACCGGA
    TTGTTTGCCG
251 CCAACGTATT GGGTCGGCAG ATCCTCGCCG CGTGGGACAG
    CCTGTTGGGG
301 CGGATTCCGG TTGTGAAAtC CATCTATTCG AGTGTGAAAA
    AAGTATCCGA
351 ATacgTGCTG TCCGACAGCA GCCGTTCGTT TAAAACGCCG
    GTACTCGTGC
401 CGTTTCCCCA GCCCGGTATT TGGACGATyG CTTTCGTGTC
    AGGGCAGGTG
451 TCGAATGCGG TTAAGGCCGC ATTGCCGAAs GACGGCGATT
    ATCTTTCCGT
501 GTATGTTCCG ACCACGCCGA ATCCGACCGG CGGTTACTAT
    ATTATGGTAA
551 AGAAAAGCGA TGTGCGCGAA CTCGATATCA GCGTGGACGA
    AsCATTGAAA
601 TATGTGATTT CGCTGGGTAT GGTCATCCCT CACGACCTGC
    CCGTCAAAAC
651 ATTGGCAsGA CCTATGCCGT CTGAAAAGGC GGATTTGCCC
    GAACAACAAT
701 AA
```

This corresponds to the amino acid sequence <SEQ ID 740; ORF98>:

```
  1 MTVTAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSEYVL SDSSRSFKTP VLVPFPQPGI WTIAFVSGQV

151 SNAVKAALPX DGDYLSVYVP TTPNPTGGYY IMVKKSDVRE LDMSVDEXLK

201 YVISLGMVIP DDLPVKTLAX PMPSEKADLP EQQ*
```

Further work revealed the complete nucleotide sequence <SEQ ID 741>:

```
  1 ATGACGGAAC nTGCGGCCGA AGGCGGCAAA GCTGCCAArG CGTTAAAAAA

51 ATATCTGATT ACGGGCATTT TGGTCTGGCT GCCGATTGCG GTAACGGTTT

101 GGGTGGTTTC CTATATCGTT TCCGCGTCCG ATCAGCTCGT CAACCTGCTG

151 CCGAAGCAAT GGCGGCCGCA ATATGTTTTG GGGTTTAATA TCCCGGGGCT

201 GGGCGTTATC GTTGCCATTG CCGTATTGTT TGTAACCGGA TTGTTTGCCG

251 CCAACGTATT GGGTCGGCAG ATCCTCGCCG CGTGGGACAG CCTGTTGGGG

301 CGGATTCCGG TTGTGAAATC CATCTATTCG AGTGTGAAAA AGTATCCGA

351 ATCGCTGCTG TCCGACAGCA GCCGTTCGTT TAAAACGCCG GTACTCGTGC

401 CGTTTCCCCA GCCCGGTATT TGGACGATTG CTTTCGTGTC AGGGCAGGTG

451 TCGAATGCGG TTAAGGCCGC ATTGCCGAAG GACGGCGATT ATCTTTCCGT

501 GTATGTTCCG ACCACGCCGA ATCCGACCGG CGGTTACTAT ATTATGGTAA

551 AGAAAAGCGA TGTGCGCGAA CTCGATATGA GCGTGGACGA AGCATTGAAA

601 TATGTGATTT CGCTGGGTAT GGTCATCCCT GACGACCTGC CCGTCAAAAC

651 ATTGGCAGGA CCTATGCCGT CTGAAAAGGC GGATTTGCCC GAACAACAAT

701 AA
```

This corresponds to the amino acid sequence <SEQ ID 742; ORF98-1>:

Computer analysis of this amino acid sequence gave the following results:

Homology with a Predicted ORF from *N. meningitidis* (Strain A)

```
  1 MTEXAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSESLL SDSSRSFKTP VLVPFPQPGI WTIAFVSGQV

151 SNAVKAALPK DGDYLSVYVP TTPNPTGGYY IMVKKSDVRE LDMSVDEALK

201 YVISLGMVIP DDLPVKTLAG PMPSEKADLP EQQ*
```

ORF98 shows 96.1% identity over a 233aa overlap with an ORF (ORF98a) from strain A of *N. meningitidis*:

```
                      10         20         30         40         50         60
orf98.pep   MTVTAAEGGKAAKALKKYLITGILVWLPIAVTVWVVSYIVSASDQLVNLLPKQWRPQYVL
            ||  ||||||||||||||||||||||||||||||||||||||||||||||||||||||||
orf98a      MTEPAAEGGKAAKALKKYLITGILVWLPIAVTVWVVSYIVSASDQLVNLLPKQWRPQYVL
                      10         20         30         40         50         60

70         80         90        100        110        120
orf98.pep   GFNIPGLGVIVAIAVLFVTGLFAANVLGRQILAAWDSLLGRIPVVKSIYSSVKKVSEYVL
            |||||||||||||||||||||||||||||||||||||||||||||||||||||||| :|
orf98a      GFNIPGLGVIVAIAVLFVTGLFAANVLGRQILAAWDSLLGRIPVVKSIYSSVKKVSXSLL
                      70         80         90        100        110        120
```

-continued

```
                    130        140        150        160        170        180
orf98.pep   SDSSRSFKTPVLVPFPQPGIWTIAFVSGQVSNAVKAALPXDGDYLSVYVPTTPNPTGGYY
            ||||||||||||||| |||||||||||||||||||||| |||||||||||||||||||||
orf98a      SDSSRSFKTPVLVPFPQSGIWTIAFVSGQVSNAVKAALPKDGDYLSVYVPTTPNPTGGYY
                    130        140        150        160        170        180

190        200        210        220        230
orf98.pep   IMVKKSDVRELDMSVDEXLKYVISLGMVIPDDLPVKTLAXPMPSEKADLPEQQX
            ||||||||||||||||| |||||||||||||||||||||| ||||||||||||
orf98a      IMVKKSDVRELDMSVDEALKYVISLGMVIPDDLPVKTLAGPMPSEKADLPEQQX
                    190        200        210        220        230
```

The complete length ORF98a nucleotide sequence <SEQ ID 743> is:

```
  1 ATGACGGAAC CTGCGGCCGA AGGCGGCAAA GCTGCCAAGG CGTTAAAAAA

51 ATATCTGATT ACGGGCATTT TGGTCTGGCT GCCGATTGCG GTAACGGTTT

101 GGGTGGTTTC CTATATCGTT TCCGCGTCCG ATCAGCTCGT CAACCTGCTG

151 CCGAAGCAAT GGCGGCCGCA ATATGTTTTG GGGTTTAATA TCCCGGGGCT

201 GGGCGTTATC GTTGCCATTG CCGTATTGTT TGTAACCGGA TTATTTGCCG

251 CAAACGTATT GGGCCGGCAG ATTCTTGCCG CGTGGGACAG CTTGTTGGGG

301 CGGATTCCGG TTGTGAAGTC CATCTATTCG AGTGTGAAAA AGTATCCGA

351 NTCGTTGCTG TCCGACAGCA GCCGTTCGTT TAAAACACCA GTACTCGTGC

401 CGTTTCCCCA ATCGGGTATT TGGACAATCG CATTCGTGTC CGGTCAGGTG

451 TCGAATGCGG TTAAGGCCGC ATTGCCGAAG GACGGCGATT ATCTTTCCGT

501 GTATGTTCCG ACCACGCCGA ATCCGACCGG CGGTTACTAT ATTATGGTAA

551 AGAAAAGCGA TGTGCGCGAA CTCGATATGA GCGTGGACGA AGCGTTGAAA

601 TATGTGATTT CGCTGGGTAT GGTCATCCCT GACGACCTGC CCGTCAAAAC

651 ATTGGCAGGA CCTATGCCGT CTGAAAAGGC GGATTTGCCC GAACAACAAT

701 AA
```

This encodes a protein having amino acid sequence <SEQ ID 744>:

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSXSLL SDSSRSFKTP VLVPFPQSGI WTIAFVSGQV

151 SNAVKAALPK DGDYLSVYVP TTPNPTGGYY IMVKKSDVRE LDMSVDEALK

201 YVISLGMVIP DDLPVKTLAG PMPSEKADLP EQQ*
```

ORF98a and ORF98-1 show 98.7% identity in 233 aa overlap:

```
                    10         20         30         40         50         60
orf98a.pep  MTEPAAEGGKAAKALKKYLITGILVWLPIAVTVWVVSYIVSASDQLVNLLPKQWRPQYVL
            ||||| |||||||||||||||||||||||||||||||||||||||||||||||||||||
orf98-1     MTEXAAEGGKAAKALKKYLITGILVWLPIAVTVWVVSYIVSASDQLVNLLPKQWRPQYVL
                    10         20         30         40         50         60

70         80         90        100        110        120
orf98a.pep  GFNIPGLGVIVAIAVLFVTGLFAANVLGRQILAAWDSLLGRIPVVKSIYSSVKKVSXSLL
            ||||||||||||||||||||||||||||||||||||||||||||||||||||||| |||
orf98-1     GFNIPGLGVIVAIAVLFVTGLFAANVLGRQILAAWDSLLGRIPVVKSIYSSVKKVSESLL
                    70         80         90        100        110        120
```

-continued

```
                       130       140       150       160       170       180
orf98a.pep    SDSSRSFKTPVLVPFPQSGIWTIAFVSGQVSNAVKAALPKDGDYLSVYVPTTPNPTGGYY
              ||||||||||||||||||||||||||||||||||||||||||||||||||||||||||||
orf98-1       SDSSRSFKTPVLVPFPQPGIWTIAFVSGQVSNAVKAALPKDGDYLSVYVPTTPNPTGGYY
                       130       140       150       160       170       180
                       190       200       210       220       230
orf98a.pep    IMVKKSDVRELDMSVDEALKYVISLGMVIPDDLPVKTLAGPMPSEKADLPEQQX
              |||||||||||||||||||||||||||||||||||||||||||||||||||||
orf98-1       IMVKKSDVRELDMSVDEALKYVISLGMVIPDDLPVKTLAGPMPSEKADLPEQQX
                       190       200       210       220       230
```

Homology with a Predicted ORF from *N. gonorrhoeae*
ORF98 shows 95.3% identity over a 233 aa overlap with a predicted ORF (ORF98ng) from *N. gonorrhoeae*:

```
                      10        20        30        40        50        60
orf98.pep    MTVTAAEGGKAAKALKKYLITGILVWLPIAVTVWVVSYIVSASDQLVNLLPKQWRPQYVL    60
             ||  ||||||||||||||||||||||||||||||||||||||||||||||||||||||||
orf98ng      MTEPAAEGGKAAKALKKYLITGILVWLPIAVTVWVVSYIVSASDQLVNLLPKQWRPQYVL    60
orf98.pep    GFNIPGLGVIVAIAVLFVTGLFAANVLGRQILAAWDSLLGRIPVVKSIYSSVKKVSEYVL   120
             ||||||||||||||||||||||||||||||||||||||||| ||||||||||||||||:|
orf98ng      GFNIPGLGVIVAIAVLFVTGLFAANVLGRQILAAWDSLLXRIPVVKSIYSSVKKVSESLL   120
orf98.pep    SDSSRSFKTPVLVPFPQPGIWTIAFVSGQVSNAVKAALPXDGDYLSVYVPTTPNPTGGYY   180
             |||||||||||||||||||||||||||||||||||||||||||||||||||||||||||||
orf98ng      SDSSRSFKTPVLVPFPQSGIWTIAFVSGQVSNAVKAALPQDGDYLSVYVPTTPNPTGGYY   180
orf98.pep    IMVKKSDVRELDMSVDEXLKYVISLGMVIPDDLPVKTLAXPMPSEKADLPEQQ          233
             |||||||||||||||||||||||||||||||||||||||:||||:||:|||||
orf98ng      IMVKKSDVRELDMSVDEALKYVISLGMVIPDDLPVKTLAGPMPPEKAELPEQQ          233
```

The complete length ORF98ng nucleotide sequence <SEQ ID 745> is predicted to encode a protein having amino acid sequence <SEQ ID 746>:

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLX

101 RIPVVKSIYS SVKKVSESLL SDSSRSFKTP VLVPFPQSGI WTIAFVSGQV

151 SNAVKAALPQ DGDYLSVYVP TTPNPTGGYY IMVKKSDVRE LDMSVDEALK

201 YVISLGMVIP DDLPVKTLAG PMPPEKAELP EQQ*
```

Further work revealed the complete nucleotide sequence <SEQ ID 747>:

```
  1 ATGACGGAAC CTGCGGCCGA AGGCGGCAAA GCTGCCAAGG CGTTAAAAAA

51 ATATCTGATT ACAGGCATTT TGGTCTGGCT GCCGATTGCG GTAACGGTTT

101 GGGTGGTTTC CTATATCGTT TCCGCGTCCG ACCAGCTTGT CAACCTGCTG

151 CCGAAGCAAT GGCGGCCGCA ATATGTTTTG GGGTTTAATA TCCCCGGGCT

201 CGGCGTTATT GTTGCCATTG CCGTATTGTT TGTAACCGGA TTATTTGCCG

251 CAAACGTGTT GGGCCGGCAG ATTCTTGCCG CGTGGGACAG CCTGTTgggg 301 cggaTTCCGG TTGTCAAATC CATCTATTCG AGTGTGAAAA AAGTATCCGA

351 ATCGCTGCTG TCCGACAGCA GCCGTTCGTT TAAAACGCCG GTACTCGTGC

401 CGTTTCCCCA ATCGGGTATT TGGACAATCG CATTCGTGTC CGGTCAGGTG

451 TCGAATGCGG TTAAGGCCGC ATTGCCGCAG GATGGCGATT ATCTTTCCGT

501 GTATGTCCCG ACCACGCCCA ACCCGACCGG CGGTTACTAT ATTATGGTAA
```

```
551 AGAAAAGCGA TGTGCGCGAA CTCGATATGA GCGTGGACGA AGCGTTGAAA

601 TATGTGATTT CGCTGGGTAT GGTCATCCCT GACGACCTGC CCGTCAAAAC

651 ATTGGCAGGA CCTATGCCGC CTGAAAAGGC GGAGTTGCCC GAACAACAAT

701 AA
```

This corresponds to the amino acid sequence <SEQ ID 748; ORF98ng-1>:

```
  1 MTEPAAEGGK AAKALKKYLI TGILVWLPIA VTVWVVSYIV SASDQLVNLL

51 PKQWRPQYVL GFNIPGLGVI VAIAVLFVTG LFAANVLGRQ ILAAWDSLLG

101 RIPVVKSIYS SVKKVSESLL SDSSRSFKTP VLVPFPQSGI WTIAFVSGQV

151 SNAVKAALPQ DGDYLSVYVP TTPNPTGGYY IMVKKSDVRE LDMSVDEALK

201 YVISLGMVIP DDLPVKTLAG PMPPEKAELP EQQ*
```

ORF98ng-1 and ORF98-1 show 97.9% identity in 233 aa overlap:

```
                         10        20        30        40        50        60
orf98-1.pep    MTEXAAEGGKAAKALKKYLITGILVWLPIAVTVWVVSYIVSASDQLVNLLPKQWRPQYVL
               ||| ||||||||||||||||||||||||||||||||||||||||||||||||||||||||
orf98ng-1      MTEPAAEGGKAAKALKKYLITGILVWLPIAVTVWVVSYIVSASDQLVNLLPKQWRPQYVL
                        10        20        30        40        50        60

70        80        90       100       110       120
orf98-1.pep    GFNIPGLGVIVAIAVLFVTGLFAANVLGRQILAAWDSLLGRIPVVKSIYSSVKKVSESLL
               ||||||||||||||||||||||||||||||||||||||||||||||||||||||||||||
orf98ng-1      GFNIPGLGVIVAIAVLFVTGLFAANVLGRQILAAWDSLLGRIPVVKSIYSSVKKVSESLL
                        70        80        90       100       110       120

130       140       150       160       170       180
orf98-1.pep    SDSSRSFKTPVLVPFPQPGIWTIAFVSGQVSNAVKAALPXDGDYLSVYVPTTPNPTGGYY
               |||||||||||||||||| |||||||||||||||||||| ||||||||||||||||||||
orf98ng-1      SDSSRSFKTPVLVPFPQSGIWTIAFVSGQVSNAVKAALPQDGDYLSVYVPTTPNPTGGYY
                        130       140       150       160       170       180

190       200       210       220       230
orf98-1.pep    IMVKKSDVRELDMSVDEALKYVISLGMVIPDDLPVKTLAGPMPSEKADLPEQQX
               |||||||||||||||||||||||||||||||||||||||||| : ||||||||
orf98ng-1      IMVKKSDVRELDMSVDEALKYVISLGMVIPDDLPVKTLAGPMPPEKAELPEQQX
                        190       200       210       220       230
```

Based on this analysis, including the fact that the putative transmembrane domains in the gonococcal protein are identical to the sequences in the meningococcal protein, it is predicted that the proteins from *N. meningitidis* and *N. gonorrhoeae*, and their epitopes, could be useful antigens for vaccines or diagnostics, or for raising antibodies.

Example 89

The following partial DNA sequence was identified in *N. meningitidis* <SEQ ID 749>:

```
  1 ATgAAAACGG TAGTCTGGAT TGTCGTCCTG TTTGCCGCCG CCGTCGGACT

51 GGCGCTGGCT TCGGGCATTT ACACCGGCGA CGTGTATATC GTACTCGGAC

101 AGACCATGCT CAGAATCAAC CTGCACGCCT TTGTGTTAGG TTCGCTGATT

151 GCCGTCGTGG TGTGGTATTT CTTGTTTAAA TTCATTATCG GsGgTACTCA

201 ATATCCCCGA AAAGATGCAG CGTTTCGGTT CGGCnCGTAA AGGCCkCAAG 251 ssCGsGCTTG CCTTGAACAA GGCGGGTTTG GCGTATTTTG AAGGGCGTTT
```

-continued

```
 301 TGAAAAGGCG GAACTAGAAG CCTCACGCGT GTTGGTCAAC AAAGtAGGCC
 351 GaGAGACAAC CGGACTTTGG CATTGATGCT GrGCGCGCAC GCCGCCGGAC
 401 AGATGGAAAA CATCGAssTG CGCGACCGTT ATCTTGCGGA AATCGCCAAA
 451 CTGCCGGAAA AACAGCAGCT TTCCCGTTAT CTTTTGTTGG CGGAATCGGC
 501 GTTGAACCGG CGCGATTACG AAGCGGCGGA AGCCAATCTT CATGCGGCGG
 551 CGAAGATGAA TGCCAACCTT ACGCGCCTCG TGCGTCTGCA .ATTCGTTAC
 601 GCTTTCGACA GGGGCGACGC GTTGCAGGTT CTGGCAAAAA CCGAAAAACT
 651 TTCCAAGGCG GGCGCGTTGG GCAAATCGGA AATGGAACGG TATCAAAATT
 701 GGGCATATCC GTCGCCAGCT GGCGGATGCT GCCGATGCCG CCGCTTTGAA
 751 AACCTGCCTG AAGCGGATTC CCGACAGCCT CAAAAACGGG GAATTGAGCG
 801 TATCGGTTGC GGAAAAGTAC GAACGTTTGG GACTGTATGC CGATGCGGTC
 851 AAATGGGTCA AACAGCATTA TCCGCAsAAC CGCCGCCCCG AGCTTTTGGA
 901 AGCCTTTGTC GAAAGCGTGC GCTTTTTGGG CGAGCGCGAA CAGCAGAAAG
 951 CCATCGATTT TGCCGATGCT TGGCTGAAAG AACAGCCCGA TAACGCGCTT
1001 CTGCTGATGT ATCTCGGTCG GCTCGCCTTC GGCCGCAAAC TTTGGGGCAA
1051 GGCAAAAGGC TACCTTGAAG CGAGCATTGC ATTAAAGCCG AGTATTTCCG
1101 CGCGTTTGGT TCTAACAAAG GTTTTCGACG AAATCGGAGA ACCGCAGAAG
1151 GCGGAGGCGC AC...
```

This corresponds to the amino acid sequence <SEQ ID 750; ORF100>:

```
  1 MKTVVWIVVL FAAAVGLALA SGIYTGDVYI VLGQTMLRIN LHAFVLGSLI
 51 AVVVWYFLFK FIIGVLNIPE KMQRFGSARK GXKXXLALNK AGLAYFEGRF
101 EKAELEASRV LVNKVGRDNR TLALMLXAHA AGQMENIXXR DRYLAEIAKL
151 PEKQQLSRYL LLAESALNRR DYEAAEANLH AAAKMNANLT RLVRLXIRYA
201 FDRGDALQVL AKTEKLSKAG ALGKSEMERY QNWAYRRQLA DAADAAALKT
251 CLKRIPDSLK NGELSVSVAE KYERLGLYAD AVKWVKQHYP XNRRPELLEA
301 FVESVRFLGE REQQKAIDFA DAWLKEQPDN ALLLMYLGRL AFGRKLWGKA
351 KGYLEASIAL KPSISARLVL TKVFDEIGEP QKAEAH...
```

Further work revealed the complete nucleotide sequence <SEQ ID 751>:

```
  1 ATGAAAACGG TAGTCTGGAT TGTCGTCCTG TTTGCCGCCG CCGTCGGACT
 51 GGCGCTGGCT TCGGGCATTT ACACCGGCGA CGTGTATATC GTACTCGGAC
101 AGACCATGCT CAGAATCAAC CTGCACGCCT TTGTGTTAGG TTCGCTGATT
151 GCCGTCGTGG TGTGGTATTT CTTGTTTAAA TTCATTATCG GCGTACTCAA
201 TATCCCCGAA AAGATGCAGC GTTTCGGTTC GGCGCGTAAA GGCCGCAAGG
251 CCGCGCTTGC CTTGAACAAG GCGGGTTTGG CGTATTTTGA AGGGCGTTTT
301 GAAAAGGCGG AACTAGAAGC CTCACGCGTG TTGGTCAACA AGAGGCCGG
```

-continued
```
 351 AGACAACCGG ACTTTGGCAT TGATGCTGGG CGCGCACGCC GCCGGACAGA

401 TGGAAAACAT CGAGCTGCGC GACCGTTATC TTGCGGAAAT CGCCAAACTG

451 CCGGAAAAAC AGCAGCTTTC CCGTTATCTT TTGTTGGCGG AATCGGCGTT

501 GAACCGGCGC GATTACGAAG CGGCGGAAGC CAATCTTCAT GCGGCGGCGA

551 AGATGAATGC CAACCTTACG CGCCTCGTGC GTCTGCAACT TCGTTACGCT

601 TTCGACAGGG GCGACGCGTT GCAGGTTCTG GCAAAAACCG AAAAACTTTC

651 CAAGGCGGGC GCGTTGGGCA AATCGGAAAT GGAACGGTAT CAAAATTGGG

701 CATACCGCCG CCAGCTGGCG GATGCTGCCG ATGCCGCCGC TTTGAAAACC

751 TGCCTGAAGC GGATTCCCGA CAGCCTCAAA AACGGGGAAT TGAGCGTATC

801 GGTTGCGGAA AAGTACGAAC GTTTGGGACT GTATGCCGAT GCGGTCAAAT

851 GGGTCAAACA GCATTATCCG CACAACCGCC GCCCCGAGCT TTTGGAAGCC

901 TTTGTCGAAA GCGTGCGCTT TTTGGGCGAG CGCGAACAGC AGAAAGCCAT

951 CGATTTTGCC GATGCTTGGC TGAAAGAACA GCCCGATAAC GCGCTTCTGC

1001 TGATGTATCT CGGTCGGCTC GCCTACGGCC GCAAACTTTG GGGCAAGGCA

1051 AAAGGCTACC TTGAAGCGAG CATTGCATTA AAGCCGAGTA TTTCCGCGCG

1101 TTTGGTTCTA GCAAAGGTTT TCGACGAAAT CGGAGAACCG CAGAAGGCGG

1151 AGGCGCAGCG CAACTTGGTT TTGGAAGCCG TCTCCGATGA CGAACGTCAC

1201 GCAGCGTTAG AGCAGCATAG CTGA
```

This corresponds to the amino acid sequence <SEQ ID 752; ORF100-1>:

```
  1 MKTVVWIVVL FAAAVGLALA SGIYTGDVYI VLGQTMLRIN LHAFVLGSLI

51 AVVVWYFLFK FIIGVLNIPE KMQRFGSARK GRKAALALNK AGLAYFEGRF

101 EKAELEASRV LVNKEAGDNR TLALMLGAHA AGQMENIELR DRYLAEIAKL

151 PEKQQLSRYL LLAESALNRR DYEAAEANLH AAAKMNANLT RLVRLQLRYA

201 FDRGDALQVL AKTEKLSKAG ALGKSEMERY QNWAYRRQLA DAADAAALKT

251 CLKRIPDSLK NGELSVSVAE KYERLGLYAD AVKWVKQHYP HNRRPELLEA

301 FVESVRFLGE REQQKAIDFA DAWLKEQPDN ALLLMYLGRL AYGRKLWGKA

351 KGYLEASIAL KPSISARLVL AKVFDEIGEP QKAEAQRNLV LEAVSDDERH

401 AALEQHS*
```

Computer analysis of this amino acid sequence gave the following results:

Homology with a Predicted ORF from *N. meningitidis* (Strain A)

ORF100 shows 93.5% identity over a 386aa overlap with an ORF (ORF100a) from strain A of *N. meningitidis*:

```
                   10         20         30         40         50         60
orf100.pep  MKTVVWIVVLFAAAVGLALASGIYTGDVYIVLGQTMLRINLHAFVLGSLIAVVVWYFLFK
            ||||||||||||||| |||||||| |||||||||||||||||||||||||||||||||||
orf100a     MKTVVWIVVLFAAAXGLALASGIXTGDVYIVLGQTMLRINLHAFVLGSLIAVVVWYFLFK
                   10         20         30         40         50         60
```

```
            70        80        90       100       110       120
orf100.pep  FIIGVLNIPEKMQRFGSARKGXKXXLALNKAGLAYFEGRFEKAELEASRVLVNKVGRDNR
            |||||||| |||||||||||||||  | |||||||||||||||||||||||| | || ||
orf100a     FIIGVLNXPEKMQRFGSARKGRKAALALNKAGLAYFEGRFEKAELEASRVLGNKEAGDNR
            70        80        90       100       110       120

130       140       150       160       170       180
orf100.pep TLALMLXAHAAGQMENIXXRDRYLAEIAKLPEKQQLSRYLLLAESALNRRDYEAAEANLH
           |||||| |||||||||||  ||||||||||||||||||||||||||||||||||||||||
orf100a    TLALMLGAHAAGQMENIELRDRYLAEIAKLPEKQQLSRYLLLAESALNRRDYEAAEANLH
           130       140       150       160       170       180

190       200       210       220       230       240
orf100.pep AAAKMNANLTRLVRLXIRYAFDRGDALQVLAKTEKLSKAGALGKSEMERYQNWAYRRQLA
           |||||||||||||||| |||||||||||||||||:||||| |||||||||||||||||:
orf100a    AAAKMNANLTRLVRLQLRYAFDRGDALQVLAKTEKXSKAGAXGKSEMERYQNWAYRRQLX
           190       200       210       220       230       240

250       260       270       280       290       300
orf100.pep DAADAAALKTCLKRIPDSLKNGELSVSVAEKYERLGLYADAVKWVKQHYPXNRRPELLEA
           |||||||||||||||||||||||||||||||||||||||||||||||||||:|||||||
orf100a    DAADAAALKTCLKRIPDSLKNGELSVSVAEKYERLGLYADAVKWVKQHYPHNRRPELLEA
           250       260       270       280       290       300

310       320       330       340       350       360
orf100.pep FVESVRFLGEREQQKAIDFADAWLKEQPDNALLLMYLGRLAFGRKLWGKAKGYLEASIAL
           ||||||||||| |||||||||||||||||||||| ||||| |||||||||||||||||||
orf100a    FVESVRFLGERDQQKAIDFADAWLKEQPDNALLLXYLGRLAYGRKLWGKAKGYLEASIAL
           310       320       330       340       350       360

370       380
orf100.pep KPSISARLVLTKVFDEIGEPQKAEAH
           |||||||||| |||||:|||||||:
orf100a    KPSISARLVLAKVFDETGEPQKAEAQRNLVLASVAEENRPSAETHX
           370       380       390       400
```

The complete length ORF100a nucleotide sequence <SEQ ID 753> is:

```
   1 ATGAAAACGG TAGTCTGGAT TGTCGTCCTG TTTGCCGCCG CNNTCGGGCT
  51 GGCATTGGCG TCGGGCATTN ACACCGGCGA CGTGTATATC GTACTCGGAC
 101 AGACCATGCT CAGAATCAAC CTGCACGCCT TTGTGTTAGG TTCGCTGATT
 151 GCCGTCGTGG TGTGGTATTT CCTGTTCAAA TTCATCATCG GCGTACTCAA
 201 TANCCCCGAA AAGATGCAGC GTTTCGGTTC GGCGCGTAAA GGCCGCAAGG
 251 CCGCGCTTGC TTTGAACAAG GCGGGTTTGG CGTATTTTGA AGGGCGTTTT
 301 GAAAAGGCGG AACTTGAAGC CTCGCGCGTA TTGGGAAACA AGAGGCGCG
 351 GGATAACCGG ACTTTGGCAT TGATGTTGGG CGCACATGCC GCCGGGCAGA
 401 TGGAAAACAT CGAGCTGCGC GACCGTTATC TTGCGGAAAT CGCCAAACTG
 451 CCGGAAAAGC AGCAGCTTTC CCGTTATCTT TTGTTGGCGG AATCGGCGTT
 501 GAACCGGCGC GATTACGAAG CGGCGGAAGC CAATCTTCAT GCGGCGGCGA
 551 AGATGAATGC CAACCTTACG CGCCTCGTGC GTCTGCAACT TCGTTACGCT
 601 TTCGACAGGG GCGACGCGTT GCAGGTTCTG GCAAAAACCG AAAAANTTTC
 651 CAAGGCGGGC GCGTNGGGCA AATCGGAAAT GGAACGGTAT CAAATTGGG
 701 CATACCGCCG CCAGCTGNCG GATGCTGCCG ATGCCGCCGC TTTGAAAACC
 751 TGCCTGAAGC GGATTCCCGA CAGCCTCAAA ACGGGGAAT TGAGCGTATC
 801 GGTTGCGGAA AAGTACGAAC GTTTGGGACT GTATGCCGAT GCGGTCAAAT
 851 GGGTCAAACA GCATTATCCG CACAACCGCC GACCCGAACT TTTGGAAGCN
 901 TTTGTCGAAA GCGTGCGCTT TTTGGGCGAA CGCGATCAGC AGAAAGCCAT
 951 CGATTTTGCC GATGCTTGGC TGAAAGAACA GCCCGATAAT GCGCTTCTGC
1001 TGANGTATCT CGGTCGGCTC GCCTACGCC GCAAACTTTG GGGCAAGGCA
1051 AAAGGCTACC TTGAAGCGAG CATTGCATTA AAGCCGAGTA TTTCCGCGCG
```

-continued

```
1101 TTTGGTTCTG GCAAAGGTTT TTGACGAAAC CGGAGAACCG CAGAAGGCGG

1151 AGGCGCAGCG CAACTTGGTT TTGGCAAGCG TTGCCGAGGA AAACCGNCCT

1201 TCCGCCGAAA CCCATTGA
```

This encodes a protein having amino acid sequence <SEQ ID 754>:

```
  1 MKTVVWIVVL FAAAXGLALA SGIXTGDVYI VLGQTMLRIN LHAFVLGSLI

51 AVVVWYFLFK FIIGVLNXPE KMQRFGSARK GRKAALALNK AGLAYFEGRF

101 EKAELEASRV LGNKEAGDNR TLALMLGAHA AGQMENIELR DRYLAEIAKL

151 PEKQQLSRYL LLAESALNRR DYEAAEANLH AAAKMNANLT RLVRLQLRYA

201 FDRGDALQVL AKTEKXSKAG AXCKSEMERY QNWAYRRQLX DAADAAALKT

251 CLKRIPDSLK NGELSVSVAE KYERLGLYAD AVKWVKQHYP HNRRPELLEA

301 FVESVRFLGE RDQQKAIDFA DAWLIEQPDN ALLLXYLGRL AYGRKLWGKA

351 KGYLEASIAL KPSISARLVL AKVFDETGEP QKAEAQRNLV LASVAEENRP

401 SAETH*
```

ORF100a and ORF100-1 show 95.1% identity in 406 aa overlap:

```
                    10        20        30        40        50        60
orf100a.pep MKTVVWIVVLFAAAXGLALASGIXTGDVYIVLGQTMLRINLHAFVLGSLIAVVVWYFLFK
            ||||||||||||||||||||||| |||||||||||||||||||||||||||||||||||
orf100-1    MKTVVWIVVLFAAAVGLALASGIYTGDVYIVLGQTMLRINLHAFVLGSLIAVVVWYFLFK
                    10        20        30        40        50        60

70        80        90       100       110       120
orf100a.pep FIIGVLNXPEKMQRFGSARKGRKAALALNKAGLAYFEGRFEKAELEASRVLGNKEAGDNR
            ||||||| |||||||||||||||||||||||||||||||||||||||||||| ||||||
orf100-1    FIIGVLNIPEKMQRFGSARKGRKAALALNKAGLAYFEGRFEKAELEASRVLVNKEAGDNR
                    70        80        90       100       110       120

130       140       150       160       170       180
orf100a.pep TLALMLGAHAAGQMENIELRDRYLAEIAKLPEKQQLSRYLLLAESALNRRDYEAAEANLH
            ||||||||||||||||||||||||||||||||||||||||||||||||||||||||||||
orf100-1    TLALMLGAHAAGQMENIELRDRYLAEIAKLPEKQQLSRYLLLAESALNRRDYEAAEANLH
                   130       140       150       160       170       180

190       200       210       220       230       240
orf100a.pep AAAKMNANLTRLVRLQLRYAFDRGDALQVLAKTEKXSKAGAXGKSEMERYQNWAYRRQLX
            |||||||||||||||||||||||||||||||||||| ||||| |||||||||||||||
orf100-1    AAAKMNANLTRLVRLQLRYAFDRGDALQVLAKTEKLSKAGALGKSEMERYQNWAYRRQLA
                   190       200       210       220       230       240

250       260       270       280       290       300
orf100a.pep DAADAAALKTCLKRIPDSLKNGELSVSVAEKYERLGLYADAVKWVKQHYPHNRRPELLEA
            ||||||||||||||||||||||||||||||||||||||||||||||||||||||||||||
orf100-1    DAADAAALKTCLKRIPDSLKNGELSVSVAEKYERLGLYADAVKWVKQHYPHNRRPELLEA
                   250       260       270       280       290       300

310       320       330       340       350       360
orf100a.pep FVESVRFLGERDQQKAIDFADAWLKEQPDNALLLXYLGRLAYGRKLWGKAKGYLEASIAL
            |||||||||||:|||||||||||||||||||||| |||||||||||||||||||||||||
orf100-1    FVESVRFLGEREQQKAIDFADAWLKEQPDNALLLMYLGRLAYGRKLWGKAKGYLEASIAL
                   310       320       330       340       350       360

370       380       390       400
orf100a.pep KPSISARLVLAKVFDETGEPQKAEAQRNLVLASVAEENRPSA-ETHX
            ||||||||||||||| |||||||||||||||| :::::|   :
orf100-1    KPSISARLVLAKVFDEIGEPQKAEAQRNLVLEAVSDDERHAALEQHSX
                   370       380       390       400
```

Homology with a Predicted ORF from *N. gonorrhoeae*

ORF100 shows 93.3% identity over a 386 aa overlap with a predicted ORF (ORF100ng) from *N. gonorrhoeae*:

```
orf100.pep    MKTVVWIVVLFAAAVGLALASGIYTGDVYIVLGQTMLRINLHAFVLGSLIAVVVWYFLFK    60
              ||||||||||||||||||||||||||||||||||||||||||||||||||||||||||||
orf100ng      MKTVVWIVVLFAAAVGLALASGIYTGDVYIVLGQTMLRINLHAFVLGSLIAVVVWYFLFK    60 orf100.pep    FIIGVLNIPEKMQRFGSARKGXKXXLALNKAGLAYFEGRFEKAELEASRVLVNKVGRDNR   120
              ||||||||||| :|:||||||||| : |||||||||||||||||||||||| ||| |||
orf100ng      FIIGVLNIPENMRRSGSARKGRKAALALNKAGLAYFEGRFEKAELEASRVLGNKEAGDNR   120 orf100.pep    TLALMLXAHAAGQMENIXXRDRYLAEIAKLPEKQQLSRYLLLAESALNRRDYEAAEANLH   180
              ||||||  ||||||||| ||||||||||||||||||||||||||||||||||||||||
orf100ng      TLALMLGAHAAGQMENIELRDRYLAEIAKLPEKQQLSRYLLLAESALNRRDYEAAEANLH   180 orf100.pep    AAAKMNANLTRLVRLXIRYAFDRGDALQVLAKTEKLSKAGALGKSEMERYQNWAYRRQLA   240
              |||||||||||||||| ||||||||||||||||||||||||||||||||||||||||:|
orf100ng      AAAKMNANLTRLVRLQLRYAFDRGDALQVLAKTEKLSKAGALGKSEMERYQNWAYRRQMA   240 orf100.pep    DAADAAALKTCLKRIPDSLKNGELSVSVAEKYERLGLYADAVKWVKQHYPXNRRPELLEA   300
              |||||||||||||||||||||||||||||||||||||||||||||||||| |||||||
orf100ng      DAADAAALKTCLKRIPDSLKNGELSVSVAEKYERLGLYADAVKWVKQHYPHNRRPELLEA   300 orf100.pep    FVESVRFLGEREQQKAIDFADAWLKEQPDNALLLMYLGRLAFGRKLWGKAKGYLEASIAL   360
              |||||||||||||||||||||| |||||||||||||||||: |||||||||||||||||
orf100ng      FVESVRFLGEREQQKAIDFADSWLKEQPDNALLLMYLGRLAYGRKLWGKAKGYLEASIAL   360 orf100.pep    KPSISARLVLTKVFDEIGEPQKAEAH                                    386
              |||| ||||| |||||  ::  ||| :
orf100ng      KPSIPARLVLAKVFDETAQSQKAEAQRNLVLASVAGENRPSAETR                 405
```

The complete length ORF100ng nucleotide sequence
<SEQ ID 755> is:

```
   1 ATGAAAACGG TAGTCTGGAT TGTTGTCCTG TTTGCCGCCG CCGTCGGACT
  51 GGCGCTGGCT TCGGGCATTT ACACCGGCGA CGTGTATATC GTACTCGGAC
 101 AGACCATGCT CAGAATCAAC CTGCACGCCT TTGTGTTAGG TTCGCTGATT
 151 GCCGTCGTGG TGTGGTATTT CCTGTTTAAA TTCATCATCG GCGTACTCAA
 201 TATCCCCGAA AATATGCGGC GTTCCGGTTC GGCGCGGAAA GGCCGCAAGG
 251 CCGCGCTTGC CTTGAATAAG GCGGGTTTGG CGTATTTCGA AGGGCGTTTT
 301 GAAAAGGCGG AACTCGAAGC CTCTCGAGTG TTGGGCAACA AGGAGGCCGG
 351 AGACAACCGG ACTTTGGCAT TGATGCTGGG CGCGCACGCG GCAGGACAGA
 401 TGGAAAATAT CGAGCTGCGC GACCGTTATC TTGCGGAAAT CGCCAAACTG
 451 CCGGAAAAAC AGCAGCTTTC CCGCTATCTT CTGCTGGCGG AATCGGCGTT
 501 AAACCGGCGC GATTACGAAG CGGCGGAAGC CAATCTTCAT GCGGCGGCGA
 551 AGATGAATGC CAACCTTACG CGCCTCGTGC GTCTGCAACT TCGTTACGCC
 601 TTCGATCGGG GCGATGCGTT GCAGGTTCTG GCAAAAaccG AAAAACTTTC
 651 CAAGGCGGGC GCGTTGGGCA AATCGGAAAT GGAACGGTAT CAAAATTGGG
 701 CATACCGCCG CCAGATGGCG GATGCTGCCG ATGCCGCCGC TTTGAAAACC
 751 TGCCTGAAGC GGATTCCCGA CAGCCTCAAA ACGGGGAAT TGagcGTATC
 801 GGTTGCGGAA AAGTACGAAC GTTTGGGACT GTATGCCGAT GCGGTCAAAT
 851 GGGTCAAACA GCATTATCCG CACAACCGCC GCCCCGAGCT TTTGGAAGCC
 901 TTTGTCGAAA GCGTGCGCTT TTTGGGCGAG CGCGAACAGC AGAAAGCCAT
 951 CGATTTTGCC GATTCTTGGC TGAAAGAACA GCCCGATAAC GCGCTTCTGC
1001 TGATGTATCT CGGCCGGCTC GCCTACGGCC GCAAACTTTG GGGTAAGGCA
1051 AAAGGCTACC TTGAAGCGAG TATTGCACTG AAGCCGAGTA TTCCGGCGCG
1101 TTTGGTGTTG GCAAAGGTTT TTGACGAAAC CGCACAGTCG CAAAAAGCCG
1151 AAGCACAGCG CAACTTGGTT TTGGCAAGCG TTGCCGGGGA AAACCGCCCT
1201 TCCGCCGAAA CCCGTTGA
```

This encodes a protein having amino acid sequence <SEQ ID 756>:

```
  1 MKTVVWIVVL FAAAVGLALA SGIYTGDVYI VLGQTMLRIN LHAFVLGSLI
 51 AVVVWYFLFK FIIGVLNIPE NMRRSGSARK GRKAALALNK AGLAYFEGRF
101 EKAELEASRV LGNKEAGDNR TLALMLGAHA AGQMENIELR DRYLAEIAKL

151 PEKQQLSRYL LLAESALNRR DYEAAEANLH AAAKMNANLT RLVRLQLRYA

201 FDRGDALQVL AKTEKLSKAG ALGKSEMERY QNWAYRRQMA DAADAAALKT

251 CLKRIPDSLK NGELSVSVAE KYERLGLYAD AVKWVKQHYP HNRRPELLEA

301 FVESVRFLGE REQQKAIDFA DSWLKEQPDN ALLLMYLGRL AYGRKLWGKA

351 KGYLEASIAL KPSIPARLVL AKVFDETAQS QKAEAQRNLV LASVAGENRP

401 SAETR*
```

ORF100ng and ORF100-1 show 95.3% identity in 402 aa overlap:

```
                      10        20        30        40        50        60
orf100-1.pep  MKTVVWIVVLFAAAVGLALASGIYTGDVYIVLGQTMLRINLHAFVLGSLIAVVVWYFLFK
              ||||||||||||||||||||||||||||||||||||||||||||||||||||||||||||
orf100ng      MKTVVWIVVLFAAAVGLALASGIYTGDVYIVLGQTMLRINLHAFVLGSLIAVVVWYFLFK
                      10        20        30        40        50        60

70        80        90       100       110       120
orf100-1.pep  FIIGVLNIPEKMQRFGSARKGRKAALALNKAGLAYFEGRFEKAELEASRVLVNKEAGDNR
              ||||||||||:|:|  ||||||||||||||||||||||||||||||||||| |||||||
orf100ng      FIIGVLNIPENMRRSGSARKGRKAALALNKAGLAYFEGRFEKAELEASRVLGNKEAGDNR
                      70        80        90       100       110       120

130       140       150       160       170       180
orf100-1.pep  TLALMLGAHAAGQMENIELRDRYLAEIAKLPEKQQLSRYLLLAESALNRRDYEAAEANLH
              ||||||||||||||||||||||||||||||||||||||||||||||||||||||||||||
orf100ng      TLALMLGAHAAGQMENIELRDRYLAEIAKLPEKQQLSRYLLLAESALNRRDYEAAEANLH
                     130       140       150       160       170       180

190       200       210       220       230       240
orf100-1.pep  AAAKMNANLTRLVRLQLRYAFDRGDALQVLAKTEKLSKAGALGKSEMERYQNWAYRRQLA
              ||||||||||||||||||||||||||||||||||||||||||||||||||||||||||:|
orf100ng      AAAKMNANLTRLVRLQLRYAFDRGDALQVLAKTEKLSKAGALGKSEMERYQNWAYRRQMA
                     190       200       210       220       230       240

250       260       270       280       290       300
orf100-1.pep  DAADAAALKTCLKRIPDSLKNGELSVSVAEKYERLGLYADAVKWVKQHYPXNRRPELLEA
              |||||||||||||||||||||||||||||||||||||||||||||||||| |||||||||
orf100ng      DAADAAALKTCLKRIPDSLKNGELSVSVAEKYERLGLYADAVKWVKQHYPHNRRPELLEA
                     250       260       270       280       290       300

310       320       330       340       350       360
orf100-1.pep  FVESVRFLGEREQQKAIDFADAWLKEQPDNALLLMYLGRLAYGRKLWGKAKGYLEASIAL
              ||||||||||||||||||||||:|||||||||||||||||||||||||||||||||||||
orf100ng      FVESVRFLGEREQQKAIDFADSWLKEQPDNALLLMYLGRLAYGRKLWGKAKGYLEASIAL
                     310       320       330       340       350       360

370       380       390       400
orf100-1.pep  KPSISARLVLAKVFDEIGEPQKAEAQRNLVLEAVSDDERHAALEQHSX
              |||| ||||||||||| ::  |||||||||||  :|: ::| :|
orf100n      KPSIPARLVLAKVFDETAQSQKAEAQRNLVLASVAGENRPSAETRX
                     370       380       390       400
```

Based on this analysis, including the presence of a putative leader sequence, a putative transmembrane domain, and a RGD motif, it is predicted that the proteins from *N. meningitidis* and *N. gonorrhoeae*, and their epitopes, could be useful antigens for vaccines or diagnostics, or for raising antibodies.

Example 90

The following DNA sequence, believed to be complete, was identified in *N. meningitidis* <SEQ ID 757>

```
  1 ATGATGTTTT CTTGGTTCAA GCTGTTTCAC TTGTTTTTTG TCATTTCGTG
 51 GTTTGCAGGG CTGTTTTACC TGCCGAGGAT TTTCGTCAAT ATGGCGATGA
101 TTGATGTGCC GCGCGGCAAT CCCGAGTATG TGCGTCTGTC GGGCATGGCG
151 GTGCGGCTGT ACCGTTTTAT GTCGCCGTTG GGCTTCGGCG CGGTCGTGTT
```

-continued

```
201 CGGCGCGGCG ATACCGTTTG CCGCCGGCTG GTGGGGCAGC GGCTGGGTAC

251 ACGTCAAACT GTGTTTGGGC TTGATGCTCT TGGCTTACCA GTTGTATTGC

301 GGCGTGCTGC TGCGCCGTTT TCAGGATTAC AGCAATGCTT TTTCACACCG

351 CTGGTACCGC GTGTTCAACG AAATCCCCGT GCTGCTGATG GTTGCCGCGC

401 TGTATsTGGT CGTGTTCAAA CCGTTTTGA
```

This corresponds to the amino acid sequence <SEQ ID 758; ORF102>:

```
  1 MMFSWFKLFH LFFVISWFAG LFYLPRIFVN MAMIDVPRGN PEYVRLSGMA

51 VRLYRFMSPL GFGAVVFGAA IPFAAGWWGS GWVHVKLCLG LMLLAYQLYC

101 GVLLRRFQDY SNAFSHRWYR VFNEIPVLLM VAALYXVVFK PF*
```

Further work revealed the complete nucleotide sequence <SEQ ID 759>:

```
  1 ATGATGTTTT CTTGGTTCAA GCTGTTTCAC TTGTTTTTTG TCATTTCGTG

51 GTTTGCAGGG CTGTTTTACC TGCCGAGGAT TTTCGTCAAT ATGGCGATGA

101 TTGATGTGCC GCGCGGCAAT CCCGAGTATG TGCGTCTGTC GGGCATGGCG

151 GTGCGGCTGT ACCGTTTTAT GTCGCCGTTG GGCTTCGGCG CGGTCGTGTT

201 CGGCGCGGCG ATACCGTTTG CCGCCGGCTG GTGGGGCAGC GGCTGGGTAC

251 ACGTCAAACT GTGTTTGGGC TTGATGCTCT TGGCTTACCA GTTGTATTGC

301 GGCGTGCTGC TGCGCCGTTT TCAGGATTAC AGCAATGCTT TTTCACACCG

351 CTGGTACCGC GTGTTCAACG AAATCCCCGT GCTGCTGATG GTTGCCGCGC

401 TGTATCTGGT CGTGTTCAAA CCGTTTTGA
```

This corresponds to the amino acid sequence <SEQ ID 760; ORF102-1>:

```
  1 MMFSWFKLFH LFFVISWFAG LFYLPRIFVN MAMIDVPRGN PEYVRLSGMA

51 VRLYRFMSPL GFGAVVFGAA IPFAAGWWGS GWVHVKLCLG LMLLAYQLYC

101 GVLLRRFQDY SNAFSHRWYR VFNEIPVLLM VAALYLVVFK PF*
```

Computer analysis of this amino acid sequence gave the following results:

Homology with HP1484 Hypothetical Integral Membrane Protein of *H. pylori* (Accession Number AE000647)
ORF102 and HP1484 show 33% aa identity in 143aa overlap:

```
orf102    3 FSWFKLFHLFFVISWFAGLFYLPRIFVNMAMIDVPRGNPEYVRLSGMAVRLYRFMSFLGF  62
            F W K FH+  VISW A LFYLPR+FV  A     +     V++     +LY F++
HP1484    8 FLWVKAFHVIAVISWMAALFYLPRLFVYHAENAHKKEFVGVVQIQEK--KLYSFIASPAM  65 orf102   63 GAVVFGAAIPFAAG---WWGSGWVHVKLCLGLMLLAYQLYCGVLLRRFQDYSNAFSHRWY  119
            G  +  +        +  GW+H KL L ++LLAY  YC  +R  +      + R+Y
Hp1484   66 GFTLITGILMLLIEPTLFKSGGWLHAKLALVVLLLAYHFYCKKCMRELEKDPTRRNARFY  125 orf102  120 RVFNEIPXXXXXXXXXXXXXFKPF                                     142
            RVFNE  P                KPF
Hp1484  126 RVFNEAPTILMILIVILVVVKFF                                      148
```

Homology with a Predicted ORF from *N. meningitidis* (Strain A)

ORF102 shows 99.3% identity over a 142aa overlap with an ORF (ORF102a) from strain A of *N. meningitidis*:

```
                       10        20        30        40        50        60
    orf102.pep  MMFSWFKLFHLFFVISWFAGLFYLPRIFVNMAMIDVPRGNPEYVRLSGMAVRLYRFMSPL
                ||||||||||||||||||||||||||||||||||||||||||||||||||||||||||||
    orf102a     MMFSWFKLFHLFFVISWFAGLFYLPRIFVNMAMIDVPRGNPEYVRLSGMAVRLYRFMSPL
                       10        20        30        40        50        60

70        80        90       100       110       120
    orf102.pep  GFGAVVFGAAIPFAAGWWGSGWVHVKLCLGLMLLAYQLYCGVLLRRFQDYSNAFSHRWYR
                ||||||||||||||||||||||||||||||||||||||||||||||||||||||||||||
    orf102a     GFGAVVFGAAIPFAAGWWGSGWVHVKLCLGLMLLAYQLYCGVLLRRFQDYSNAFSHRWYR
                       70        80        90       100       110       120

130       140
    orf102.pep  VFNEIPVLLMVAALYXVVFKPFX
                ||||||||||||||| |||||||
    orf102a     VFNEIPVLLMVAALYLVVFKPFX
                      130       140
```

The complete length ORF102a nucleotide sequence <SEQ ID 761> is:

```
  1 ATGATGTTTT CTTGGTTCAA GCTGTTTCAC TTGTTTTTTG TCATTTCGTG

51 GTTTGCAGGG CTGTTTTACC TGCCGAGGAT TTTCGTCAAT ATGGCGATGA

101 TTGATGTGCC GCGCGGCAAT CCCGAGTATG TGCGTCTGTC GGGCATGGCG

151 GTGCGGCTGT ACCGTTTTAT GTCGCCGTTG GGCTTCGGCG CGGTCGTGTT

201 CGGCGCGGCG ATACCGTTTG CCGCCGGCTG GTGGGGCAGC GGCTGGGTAC

251 ACGTCAAACT GTGTTTGGGC TTGATGCTCT TGGCTTACCA GTTGTATTGC

301 GGCGTGCTGC TGCGCCGTTT TCAGGATTAC AGCAATGCTT TTTCACACCG

351 CTGGTACCGC GTGTTCAACG AAATCCCCGT GCTGCTGATG GTTGCCGCGC

401 TGTATCTGGT CGTGTTCAAA CCGTTTTGA
```

This encodes a protein having amino acid sequence <SEQ ID 762>:

```
  1 MMFSWFKLFH LFFVISWFAG LFYLPRIFVN MAMIDVPRGN PEYVRLSGMA

51 VRLYRFMSPL GFGAVVFGAA IPFAAGWWGS GWVHVKLCLG LMLLAYQLYC

101 GVLLRRFQDY SNAFSHRWYR VFNEIPVLLM VAALYLVVFK PF*
```

ORF102a and ORF102-1 show complete identity in 142 aa overlap:

```
                       10        20        30        40        50        60
    orf102a.pep MMFSWFKLFHLFFVISWFAGLFYLPRIFVNMAMIDVPRGNPEYVRLSGMAVRLYRFMSPL
                ||||||||||||||||||||||||||||||||||||||||||||||||||||||||||||
    orf102-1    MMFSWFKLFHLFFVISWFAGLFYLPRIFVNMAMIDVPRGNPEYVRLSGMAVRLYRFMSPL
                       10        20        30        40        50        60

70        80        90       100       110       120
    orf102a.pep GFGAVVFGAAIPFAAGWWGSGWVHVKLCLGLMLLAYQLYCGVLLRRFQDYSNAFSHRWYR
                ||||||||||||||||||||||||||||||||||||||||||||||||||||||||||||
    orf102-1    GFGAVVFGAAIPFAAGWWGSGWVHVKLCLGLMLLAYQLYCGVLLRRFQDYSNAFSHRWYR
                       70        80        90       100       110       120
```

-continued

```
                 130        140
orf102a.pep  VFNEIPVLLMVAALYLVVFKPFX
             ||||||||||||||||||||||
orf102-1     VFNEIPVLLMVAALYLVVFKPFX
                 130        140
```

Homology with a Predicted ORF from *N. gonorrhoeae*

ORF102 shows 97.9% identity over a 142 aa overlap with a predicted ORF (ORF102ng) from *N. gonorrhoeae*:

```
orf102.pep  MMFSWFKLFHLFFVISWFAGLFYLPRIFVNMAMIDVPRGNPEYVRLSGMAVRLYRFMSPL  60
            |||||||||||||||||||||||||||||||||||:||||||||||||||||||||||||
orf102ng    MMFSWFKLFHLFFVISWFAGLFYLPRIFVNMAMIDAPRGNPEYVRLSGMAVRLYRFMSPL  60 orf102.pep  GFGAVVFGAAIPFAAGWWGSGWVHVKLCLGLMLLAYQLYCGVLLRRFQDYSNAFSHRWYR  120
            ||||||||||||||||| |||||||||||||||||||||||||||||||||||||||||
orf102ng    GFGAVVFGAAIPFAAGRWGSGWVHVKLCLGLMLLAYQLYCGVLLRRFQDYSNAFSHRWYR  120 orf102.pep  VFNEIPVLLMVAALYXVVFKPF  142
            ||||||||||||||| ||||||
orf102ng    VFNEIPVLLMVAALYLVVFKPF  142
```

The complete length ORF102ng nucleotide sequence <SEQ ID 763> is:

```
  1 ATGATGTTTT CTTGGTTCAA GCTGTTTCAC TTGTTTTTTG TCATTTCGTG
 51 GTTTGCAGGG CTGTTTTACC TGCCGAGGAT TTTCGTCAAT ATGGCGATGA
101 TTGATGCGCC GCGCGGCAAT CCCGAGTATG TGCGCCTGTC GGGGATGGCG
151 GTGCGGTTGT ACCGTTTTAT GTCGCCTTTG GGTTTCGGCG CGGTCGTGTT
201 CGGCGCGGCG ATACCGTTTG CCGCcggccg GTGGGGCagc ggctggGTTC
251 ACGTCAAACT GTGTTTGGGC TTGATGCTCT TGGCTTATCA GTTGTATTGC
301 GGCGTGCTGC TGCGCCGTTT TCAGGATTAC AGCAATGCTT TTCACACCG
351 CTGGTACCGC GTGTTCAAcg aAATCCCCGT GCTGCTGATG GTTGCCGCGC
401 TGTATCTGGT CGTGTTCAAA CCGTTTTGA
```

This encodes a protein having amino acid sequence <SEQ ID 764>:

```
  1 MMFSWFKLFH LFFVISWFAG LFYLPRIFVN MAMIDAPRGN PEYVRLSGMA
 51 VRLYRFMSPL GFGAVVFGAA IPFAAGRWGS GWVHVKLCLG LMLLAYQLYC
101 GVLLRRFQDY SNAFSHRWYR VFNEIPVLLM VAALYLVVFK PF*
```

ORF102ng and ORF102-1 show 98.6% identity in 142 aa overlap:

```
                      10         20         30         40         50         60
orf102-1.pep  MMFSWFKLFHLFFVISWFAGLFYLPRIFVNMAMIDVPRGNPEYVRLSGMAVRLYRFMSPL
              |||||||||||||||||||||||||||||||||||:||||||||||||||||||||||||
orf102ng      MMFSWFKLFHLFFVISWFAGLFYLPRIFVNMAMIDAPRGNPEYVRLSGMAVRLYRFMSPL
                      10         20         30         40         50         60
```

```
                    70         80         90        100        110        120
orf102-1.pep  GFGAVVFGAAIPFAAGWWGSGWVHVKLCLGLMLLAYQLYCGVLLRRFQDYSNAFSHRWYR
              ||||||||||||||||| ||||||||||||||||||||||||||||||||||||||||||
orf102ng      GFGAVVFGAAIPFAAGRWGSGWVHVKLCLGLMLLAYQLYCGVLLRRFQDYSNAFSHRWYR
                    70         80         90        100        110        120
                   130        140
orf102-1.pep  VFNEIPVLLMVAALYLVVFKPFX
              |||||||||||||||||||||||
orf102ng      VFNEIPVLLMVAALYLVVFKPFX
                   130        140
```

In addition, ORF102ng shows significant homology to a membrane protein from *H. pylori*:

```
gi|2314656 (AE000647) conserved hypothetical integral membrane protein
[Helicobacter pylori] Length = 148
Score = 79.2 bits (192), Expect = 1e - 14
Identities = 50/147 (34%), Positives = 68/147 (46%), Gaps = 13/147 (8%)

Query:    3 FSWFKLFHLFFVISWFAGLFYLPRIFVNMAMIDAPRGNPEYVRLSGMAVRLYRFMSPLGF   62
            F W K FH+  VISW A LFYLPR+FV  A       +V++    +LY F++
Sbjct:    8 FLWVKAFHVIAVISWMAALFYLPRLFVYHAENAHKKEFVGVVQIEK--KLYSFIASPAM   65

Query:   63 GAVVFGAAIP-------FAAGRWGSGWVHVKLCLGLMLLAYQLYCGVLLRRFQDYSNAFS  115
            G  +   +        F +G    GW+H KL L ++LLAY  YC  +R  +     +
Sbjct:   66 GFTLITGILMLLIEPTLFKSG----GWLHAKLALVVLLLAYHFYCKKCMRELEKDPTRRN  121

Query:  116 HRWYRVFNEIPXXXXXXXXXXXXFKPF                                  142
            R+YRVFNE P             KPF
Sbjct:  122 ARFYRVFNEAPTILMILIVILVVVKPF                                  148
```

Based on this analysis, it is predicted that these proteins from *N. meningitidis* and *N. gonorrhoeae*, and their epitopes, could be useful antigens for vaccines or diagnostics, or for raising antibodies.

Example 91

The following partial DNA sequence was identified in *N. meningitidis* <SEQ ID 765>:

```
  1 ATGGCAAAAA TGATGAAATG GGCGGCTGTT GCGGCGGTCG CGGCGGCAGC
 51 GGTTTGGGGC GGATGGTCTT AACTGAAGCC CGAGCCGCAC GTGCTTGATA
101 TTACGGAAAC GGTCAGGCGC GGC // .....

//.. ATTTCGTTTA CGATTTTGTC CGAACCGGAT ACGCCGATTA AGGCGAAGCT
 51 CGACAGCGTC GACCCCGGGC TGACCACGAT GTCGTCGGGC GGTTACAACA
101 GCAGTACGGA TACGGCTTCC AATGCGGTCT ACTATTATGC CCGTTCGTTT
151 GTGCCGAATC CGGACGGCAA ACTCGCCACG GGGATGACGA CGCAGAATAC
201 GGTTGAAATC GACGGCGTGA AAAATGTGCT GATTATTCCG TCGCTGACCG
251 TGAAAAATCG CGGCGGCAAG GCGTTTGTGC GCGTGTTGGG TGCGGACGGC
301 AAGGCGGCGG AACGCGAAAT CCGGACCGGT ATGAGAGACA GTATGAATAC
351 CGAAGTAAAA AGCGGGTTGA AGAGGGGGA CAAAGTGGTC ATCTCCGAAA
401 TAACCGCCGC CGAGCAACAG GAAAGCGGCG AACGCGCCCT AGGCGGCCCG
451 CCGCGCCGAT AA
```

This corresponds to the amino acid sequence <SEQ ID 766; ORF85>:

```
  1 MAKMMKWAAV AAVAAAAVWG GWS.LKPEPH VLDITETVRR G.........
 51 .......... .......... .......... .......... ..........
101 .......... .......... .......... .......... ..........
151 .......... .......... .......... .......... ..........
201 .......... .......... .......... ..........I SFTILSEPDT
251 PIKAKLDSVD PGLTTMSSGG YNSSTDTASN AVYYYARSFV PNPDGKLATG
301 MTTQNTVEID GVKNVLIIPS LTVKNRGGKA FVRVLGADGK AAEREIRTGM
351 RDSMNTEVKS GLKEGDKVVI SEITAAEQQE SGERALGGPP RR*
```

Further work revealed the further partial nucleotide sequence <SEQ ID 767>:

```
   1 ..GTATCGGTCG GCGCGCAGGC ATCGGGGCAG ATTAAGATAC TTTATGTCAA
  51 ACTCGGGCAA CAGGTTAAAA AGGGCGATTT GATTGCGGAA ATCAATTCGA
 101 CCTCGCAGAC CAATACGCTC AATACGGAAA ATCCAAGTT GGAAACGTAT
 151 CAGGCGAAGC TGGTGTCGGC ACAGATTGCA TTGGGCAGCG CGGAGAAGAA
 201 ATATAAGCGT CAGGCGGCGT TATGGAAGGA AAACGCGACT TCCAAAGAGG
 251 ATTTGGAAAG CGCGCAGGAT GCGTTTGCCG CCGCCAAAGC CAATGTTGCC
 301 GAGCTGAAGG CTTTAATCAG ACAGAGCAAA ATTTCCATCA ATACCGCCGA
 351 GTCGGAATTG GGCTACACGC GCATTACCGC AACGATGGAC GGCACGGTGG
 401 TGGCGATTCT CGTGGAAGAG GGGCAGACTG TGAACGCGGC GCAGTCTACG
 451 CCGACGATTG TCCAATTGGC GAATCTGGAT ATGATGTTGA ACAAAATGCA
 501 GATTGCCGAG GCGATATTA CCAAGGTGAA GGCGGGGCAG GATATTTCGT
 551 TTACGATTTT GTCCGAACCG GATACGCCGA TTAAGGCGAA GCTCGACAGC
 601 GTCGACCCCG GGCTGACCAC GATGTCGTCG GGCGGTTACA ACAGCAGTAC
 651 GGATACGGCT TCCAATGCGG TCTACTATTA TGCCCGTTCG TTTGTGCCGA
 701 ATCCGGACGG CAAACTCGCC ACGGGGATGA CGACGCAGAA TACGGTTGAA
 751 ATCGACGGCG TGAAAAATGT GCTGATTATT CCGTCGCTGA CCGTGAAAAA
 801 TCGCGGCGGC AAGGCGTTTG TGCGCGTGTT GGGTGCGGAC GGCAAGGCGG
 851 CGGAACGCGA AATCCGGACC GGTATGAGAG ACAGTATGAA TACCGAAGTA
 901 AAAAGCGGGT TGAAAGAGGG GGACAAAGTG GTCATCTCCG AAATAACCGC
 951 CGCCGAGCAA CAGGAAAGCG GCGAACGCGC CCTAGGCGGC CCGCCGCGCC
1001 GATAA
```

This corresponds to the amino acid sequence <SEQ ID 768; ORF85-1>:

```
  1 ..VSVGAQASGQ IKILYVKLGQ QVKKGDLIAE INSTSQTNTL NTEKSKLETY
 51 QAKLVSAQIA LGSAEKKYKR QAALWKENAT SKEDLESAQD AFAAAKANVA
101 ELKALIRQSK ISINTAESEL GYTRITATMD GTVVAILVEE GQTVNAAQST
```

```
-continued
151 PTIVQLANLD MMLNKMQIAE GDITKVKAGQ DISFTILSEP DTPIKAKLDS

201 VDPGLTTMSS GGYNSSTDTA SNAVYYYARS FVPNPDGKLA TGMTTQNTVE

251 IDGVKNVLII PSLTVKNRGG KAFVRVLGAD GKAAEREIRT GMRDSMNTEV

301 KSGLKEGDKV VISEITAAEQ QESGERALGG PPRR*
```

Computer analysis of this amino acid sequence gave the following results:

Homology with a Predicted ORF from *N. meningitidis* (Strain A)

ORF85 shows 87.8% identity over a 41aa overlap and 99.3% identity over a 153aa overlap with an ORF (ORF85a) from strain A of *N. meningitidis*:

```
                  10        20        30        40
orf85.pep    MAKMMKWAAVAAVAAAAVWGGWS-LKPEPHVLDITETVRRG
             ||||||||||||||||||||||| ||||::  |||||||
orf85a       MAKMMKWAAVAAVAAAAVWGGWSYLKPEPQAAYITETVRRGDISRTVSATGEISPSNLVS
                  10        20        30        40        50        60
                                    //
                               80        90       100
orf85.pep    .........................ISFTILSEPDTPIKAKLDSVDPGLTTMSSG
                                      ||||||||||||||||||||||||||||||
orf85a       TIVQLANLDMMLNKMQIAEGDITKVKAGQDISFTILSEPDTPIKAKLDSVDPGLTTMSSG
              210       220       230       240       250       260
                 110       120       130       140       150       160
orf85.pep    GYNSSTDTASNAVYYYARSFVPNPDGKLATGMTTQNTVEIDGVKNVLIIPSLTVKNRGGK
             |||||||||||||||||||||||||||||||||||||||||||||||||||||||||||:
orf85a       GYNSSTDTASNAVYYYARSFVPNPDGKLATGMTTQNTVEIDGVKNVLIIPSLTVKNRGGR
              270       280       290       300       310       320
                 170       180       190       200       210       220
orf85.pep    AFVRVLGADGKAAEREIRTGMRDSMNTEVKSGLKEGDKVVISEITAAEQQESGERALGGP
             ||||||||||||||||||||||||||||||||||||||||||||||||||||||||||||
orf85a       AFVRVLGADGKAAEREIRTGMRDSMNTEVKSGLKEGDKVVISEITAAEQQESGERALGGP
              330       340       350       360       370       380
                 230
orf85.pep    PRRX
             ||||
orf85a       PRRX
              390
```

The complete length ORF85a nucleotide sequence <SEQ ID 769> is:

```
  1 ATGGCAAAAA TGATGAAATG GCGGCTGTT GCGGCGGTCG CGGCGGCAGC

51 GGTTTGGGGC GGATGGTCTT ATCTGAAGCC CGAGCCGCAG GCTGCTTATA

101 TTACGGAAAC GGTCAGGCGC GGCGACATCA GCCGGACGGT TTCTGCAACA

151 GGGGAGATTT CGCCGTCCAA CCTGGTATCG GTCGGCGCGC AGGCATCGGG

201 GCAGATTAAG AAACTTTATG TCAAACTCGG CCAACAGGTT AAAAAGGGCG

251 ATTTGATTGC GGAAATCAAT TCGACCTCGC AGACCAATAC GCTCAATACG

301 GAAAAATCCA AATTGGAAAC GTATCAGGCG AAGCTGGTGT CGGCACAGAT

351 TGCATTGGGC AGCGCGGAGA AGAAATATAA GCGTCAGGCG GCGTTGTGGA

401 AGGATGATGC GACCGCTAAA GAAGATTTGG AAAGCGCACA GGATGCGCTT

451 GCCGCCGCCA AAGCCAATGT TGCCGAGCTG AAGGCTCTAA TCAGACAGAG

501 CAAAATTTCC ATCAATACCG CCGAGTCGGA ATTGGGCTAC ACGCGCATTA
```

```
-continued
 551 CCGCAACGAT GGACGGCACG GTGGTGGCGA TTCTCGTGGA AGAGGGGCAG

601 ACTGTGAACG CGGCGCAGTC TACGCCGACG ATTGTCCAAT TGGCGAATCT

651 GGATATGATG TTGAACAAAA TGCAGATTGC CCAGGGCGAT ATTACCAAGG

701 TGAAGGCGGG GCAGGATATT TCGTTTACGA TTTTGTCCGA ACCGGATACG

751 CCGATTAAGG CGAAGCTCGA CAGCGTCGAC CCCGGGCTGA CCACGATGTC

801 GTCGGGCGGC TACAACAGCA GTACGGATAC GGCTTCCAAT GCGGTCTACT

851 ATTATGCCCG TTCGTTTGTG CCGAATCCGG ACGGCAAACT CGCCACGGGG

901 ATGACGACGC AGAATACGGT TGAAATCGAC GGTGTGAAAA ATGTGCTGAT

951 TATTCCGTCG CTGACCGTGA AAAATCGCGG CGGCAGGGCG TTTGTGCGCG

1001 TGTTGGGTGC AGACGGCAAG GCGGCGGAAC GCGAAATCCG GACCGGTATG

1051 AGAGACAGTA TGAATACCGA AGTAAAAAGC GGGTTGAAAG AGGGGACAA

1101 AGTGGTCATC TCCGAAATAA CCGCCGCCGA GCAGCAGGAA AGCGGCGAAC

1151 GCGCCCTAGG CGGCCCGCCG CGCCGATAA
```

This encodes a protein having amino acid sequence <SEQ ID 770>:

```
  1 MAKMMKWAAV AAVAAAAVWG GWSYLKPEPQ AAYITETVRR GDISRTVSAT

51 GEISPSNLVS VGAQASGQIK KLYVKLGQQV KKGDLIAEIN STSQTNTLNT

101 EKSKLETYQA KLVSAQIALG SAEKKYKRQA ALWKDDATAK EDLESAQDAL

151 AAAKANVAEL KALIRQSKIS INTAESELGY TRITATMDGT VVAILVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLIIPS LTVKNRGGRA FVRVLGADGK AAEREIRTGM

351 RDSMNTEVKS GLKEGDKVVI SEITAAEQQE SGERALGGPP RR*
```

ORF85a and ORF85-1 show 98.2% identity in 334 aa overlap:

```
                    30        40        50        60        70        80
       orf85a.pep   PQAAYITETVRRGDISRTVSATGEISPSNLVSVGAQASGQIKKLYVKLGQQVKKGDLIAE
                                             |||||||||||||| |||||||||||||||||||
       orf85-1                               VSVGAQASGQIKILYVKLGQQVKKGDLIAE
                                             10        20        30

90       100       110       120       130       140
       orf85a.pep   INSTSQTNTLNTEKSKLETYQAKLVSAQIALGSAEKKYKRQAALWKDDATAKEDLESAQD
                    |||||||||||||||||||||||||||||||||||||||||||||::|:|||||||||
       orf85-1      INSTSQTNTLNTEKSKLETYQAKLVSAQIALGSAEKKYKRQAALWKENATSKEDLESAQD
                    40        50        60        70        80        90

150       160       170       180       190       200
       orf85a.pep   ALAAAKANVAELKALIRQSKISINTAESELGYTRITATMDGTVVAILVEEGQTVNAAQST
                    |:||||||||||||||||||||||||||||||||||||||||||||||||||||||||
       orf85-1      AFAAAKANVAELKALIRQSKISINTAESELGYTRITATMDGTVVAILVEEGQTVNAAQST
                   100       110       120       130       140       150

210       220       230       240       250       260
       orf85a.pep   PTIVQLANLDMMLNKMQIAEGDITKVKAGQDISFTILSEPDTPIKAKLDSVDPGLTTMSS
                    ||||||||||||||||||||||||||||||||||||||||||||||||||||||||||
       orf85-1      PTIVQLANLDMMLNKMQIAEGDITKVKAGQDISFTILSEPDTPIKAKLDSVDPGLTTMSS
                   160       170       180       190       200       210

270       280       290       300       310       320
       orf85a.pep   GGYNSSTDTASNAVYYYARSFVPNPDGKLATGMTTQNTVEIDGVKNVLIIPSLTVKNRGG
                    ||||||||||||||||||||||||||||||||||||||||||||||||||||||||||
       orf85-1      GGYNSSTDTASNAVYYYARSFVPNPDGKLATGMTTQNTVEIDGVKNVLIIPSLTVKNRGG
                   220       230       240       250       260       270
```

-continued

```
                       330       340       350       360       370       380
orf85a.pep    RAFVRVLGADGKAAEREIRTGMRDSMNTEVKSGLKEGDKVVISEITAAEQQESGERALGG
              :|||||||||||||||||||||||||||||||||||||||||||||||||||||||||
orf85-1       KAFVRVLGADGKAAEREIRTGMRDSMNTEVKSGLKEGDKVVISEITAAEQQESGERALGG
                       280       290       300       310       320       330

390
orf85a.pep    PPRRX
              |||||
orf85-1       PPRRX
```

Figure 19D:
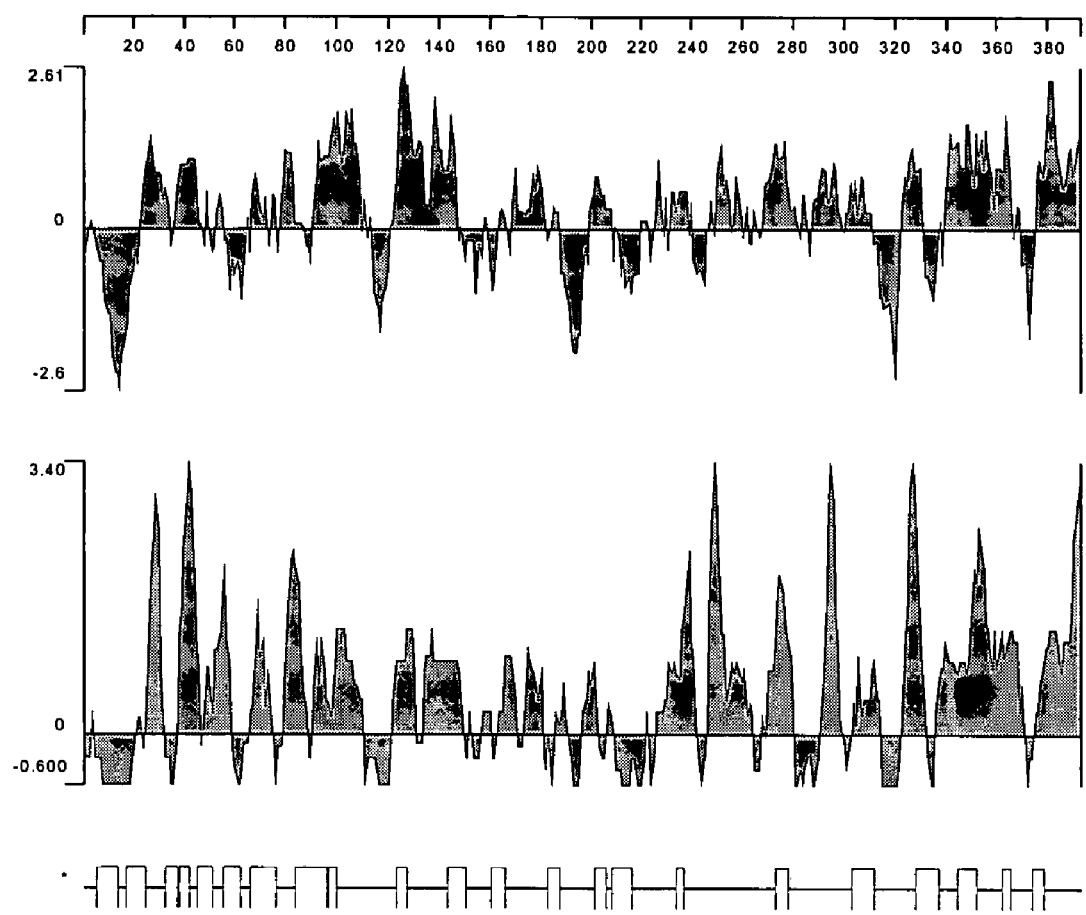

FIG. 19D shows plots of hydrophilicity, antigenic index, and AMPHI regions for ORF85a.

Homology with a predicted ORF from N. gonorrhoeae

ORF85 shows a high degree of identity with a predicted ORF (ORF85ng) from N. gonorrhoeae:

```
ORF85     1   MAKMMKWAAVAAVAAAAVWGGWS.LKPEPHVLDITETVRRG.........    40
              ||||||||||||||||||||||| ::   |||:||||
ORF85ng   1   MAKMMKWAAVAAVAAAAVWGGWSYLKPEPQAAYITEAVRRGDISRTVSAT    50

ORF85         ........................................ISFTILSEPDT   250
                                                        ||||||||||
ORF85ng   201 TVNAAQSTPTIVQLANLDMMLNKMQIAEGDITKVKAGQDISFTILSEPDT   250

ORF85     251 PIKAKLDSVDPGLTTMSSGGYNSSTDTASNAVYYYARSFVPNPDGKLATG   300
              |||||||||||||||||||||||||||||||||||||||||||||||||
ORF85ng   251 PIKAKLDSVDPGLTTMSSGGYNSSTDTASNAVYYYARSFVPNPDGKLATG   300

ORF85     301 MTTQNTVEIDGVKNVLIIPSLTVKNRGGKAFVRVLGADGKAAEREIRTGM   350
              ||||||||||||||||| |||||||||||||||||||||||  ||||||
ORF85ng   301 MTTQNTVEIDGVKNVLLIPSLTVKNRGGKAFVRVLGADGKAVEREIRTGM   350

ORF85     152 RDSMNTEVKSGLKEGDKVVISEITAAEQQESGERALGGPPRR    393
              :||||||||||||||||||||||||||||||||||||||||
ORF85ng   351 KDSMNTEVKSGLKEGDKVVISEITAAEQQESGERALGGPPRR    393
```

The complete length ORF85ng nucleotide sequence <SEQ ID 771> is:

```
  1 ATGGCAAAAA TGATGAAATG GGCGGCTGTT GCGGCGGTCG CGGCGGCaac

51 GGTTTGGGGC GGATGGTCTT ATCTGAAGCC CGAACCGCAG GCTGCTTATA

101 TTACGGAaac ggTCAGGCGC GGCGATATCA GCCGGACGGT TTCCGCGACG

151 GgcgAGATTT CGCCGTCCAA CCTGGTATCG GTCGGCGCGC AGGCTTCGGG

201 GCAGATTAAA AAGCTTTATG TCAAACTCGG GCAACAGGTC AAAAAGGGCG

251 ATTTGATTGC GGAAATCAAT TCGACCACGC AGACCAACAC GATCGATATG

301 GAAAAATCCA AATTGGAAAC GTATCAGGCG AAGCTGGTGT CGGCACAGAT

351 TGCATTGGGC AGCGCGGAGA AGAAATATAA GCGTCAGGCG GCGTTGTGGA

401 AGGATGATGC GACCTCTAAA GAAGATTTGG AAAGCGCGCA GGATGCGCTT

451 GCCGCCGCCA AAGCCAATGT TGCCGAGTTG AAGGCTTTAA TCAGACAGAG

501 CAAAATTTCC ATCAATACCG CCGAGTCGGA TTTGGGCTAC ACGCGCATTA

551 CCGCGACGAT GGACGGCACG GTGGTGGCGA TTCCCGTGGA AGAGGGGCAG

601 ACTGTGAACG CGGCGCAGTC TACGCCGACG ATTGTCCAAT TGGCGAATCT

651 GGATATGATG TTGAACAAAA TGCAGATTGC CGAGGGCGAT ATTACCAAGG

701 TGAAGGCGGG GCAGGATATT TCGTTTACGA TTTTGTCCGA ACCGGATACG

751 CCGATTAAGG CGAAGCTCGA CAGCGTCGAC CCCGGGCTGA CCACGATGTC
```

-continued

```
 801 GTCGGGCGGC TACAACAGCA GTACGGATAC GGCTTCCAAT GCGGTCTATT
 851 ATTATGCCCG TTCGTTTGTG CCGAATCCGG ACGGCAAACT CGCCACGGGG
 901 ATGACGACGC AGAATACGGT TGAAATCGAC GGTGTGAAAA ATGTGTTGCT
 951 TATTCCGTCG CTGACCGTGA AAAATCGCGG CGGCAAGGCG TTCGTACGCG
1001 TGTTGGGTGC GGACGGCAAG GCAGTGGAAC GCGAAATCCG GACCGGTATG
1051 AAAGACAGTA TGAATACCGA AGTGAAAAGC GGGTTGAAAG AGGGGGACAA
1101 AGTGGTCATC TCCGAAATAA CCGCCGCCGA GCAGCAGGAA AGCGGCGAAC
1151 GCGCCCTAGG CGGCCCGCCG CGCCGATAA
```

This encodes a protein having amino acid sequence <SEQ ID 772>:

```
  1 MAKMMKWAAV AAVAAAAVWG GWSYLKPEPQ AAYITEAVRR GDISRTVSAT
 51 GEISPSNLVS VGAQASGQIK KLYVKLGQQV KKGDLIAEIN STTQTNTIDM
101 EKSKLETYQA KLVSAQIALG SAEKKYKRQA ALWKDDATSK EDLESAQDAL
151 AAAKANVAEL KALIRQSKIS INTAESDLGY TRITATMDGT VVAIPVEEGQ
201 TVNAAQSTPT IVQLANLDMM LNKMQIAEGD ITKVKAGQDI SFTILSEPDT
251 PIKAKLDSVD PGLTTMSSGG YNSSTDTASN AVYYYARSFV PNPDGKLATG
301 MTTQNTVEID GVKNVLLIPS LTVKNRGGKA FVRVLGADGK AVEREIRTGM
351 KDSMNTEVKS GLKEGDKVVI SEITAAEQQE SGERALGGPP RR*
```

ORF85ng and ORF85-1 show 96.1% identity in 334 aa overlap:

```
                  30         40         50         60         70         80
        orf85ng PQAAYITETVRRGDISRTVSATGEISPSNLVSVGAQASGQIKKLYVKLGQQVKKGDLIAE
                                        ||||||||||||||||||||||||||:|||||||||
        orf85-1                         VSVGAQASGQIKILYVKLGQQVKKGDLIAE
                                         10         20         30
                  90        100        110        120        130        140
        orf85ng INSTTQTNTIDMEKSKLETYQAKLVSAQIALGSAEKKYKRQAALWKDDATSKEDLESAQD
                |||:||||:::||||||||||||||||||||||||||||||||||::||||||||||||
        orf85-1 INSTSQTNTLNTEKSKLETYQAKLVSAQIALGSAEKKYKRQAALWKENATSKEDLESAQD
                         40         50         60         70         80         90
                 150        160        170        180        190        200
        orf85ng ALAAAKANVAELKALIRQSKISINTAESDLGYTRITATMDGTVVAIPVEEGQTVNAAQST
                |:||||||||||||||||||||||||||:|||||||||||||||:|||||||||||||
        orf85-1 AFAAAKANVAELKALIRQSKISINTAESELGYTRITATMDGTVVAILVEEGQTVNAAQST
                         100        110        120        130        140        150
                 210        220        230        240        250        260
        orf85ng PTIVQLANLDMMLNKMQIAEGDITKVKAGQDISFTILSEPDTPIKAKLDSVDPGLTTMSS
                ||||||||||||||||||||||||||||||||||||||||||||||||||||||||||||
        orf85-1 PTIVQLANLDMMLNKMQIAEGDITKVKAGQDISFTILSEPDTPIKAKLDSVDPGLTTMSS
                         160        170        180        190        200        210
                 270        280        290        300        310        320
        orf85ng GGYNSSTDTASNAVYYYARSFVPNPDGKLATGMTTQNTVEIDGVKNVLLIPSLTVKNRGG
                ||||||||||||||||||||||||||||||||||||||||||||||||:|||||||||||
        orf85-1 GGYNSSTDTASNAVYYYARSFVPNPDGKLATGMTTQNTVEIDGVKNVLIIPSLTVKNRGG
                         220        230        240        250        260        270
                 330        340        350        360        370        380
        orf85ng KAFVRVLGADGKAVEREIRTGMKDSMNTEVKSGLKEGDKVVISEITAAEQQESGERALGG
                ||||||||||||||:|||||||:|||||||||||||||||||||||||||||||||||||
        orf85-1 KAFVRVLGADGKAAEREIRTGMRDSMNTEVKSGLKEGDKVVISEITAAEQQESGERALGG
                         280        290        300        310        320        330
                 390
        orf85ng PPRRX
                |||||
        orf85-1 PPRRX
```

In addition, ORF85ng shows significant homology to an *E. coli* membrane fusion protein:

```
gi|1787104 (AE000189) o380; 27% identical (27 gaps) to 332 residues from
membrane fusion protein precursor, MTRC_NEIGO SW: P43505 (412 aa)
[Escherichia coli] Length = 380
Score = 193 bits (485), Expect = 2e-48
Identities = 120/345 (34%), Positives = 182/345 (51%), Gaps = 13/345 (3%)

Query:  29 PQAAYITETVRRGDISRTVSATGEISPSNLVSVGAQASGQIKKLYVKLGQQVKKGDLIAE  88
            P   Y T  VR GD+ ++V ATG++     V VGAQ SGQ+K L V  +G +VKK  L+
Sbjct:  41 PVPTYQTLIVRPGDLQQSVLATGKLDALRKVDVGAQVSGQLKTLSVAIGDKVKKDQLLGV 100

Query:  89 INSTTQTNTIDMEKSKLETYQAKLVSAQIALGSAEKKYKRQAALWKDDATSKEXXXXXXX 148
            I+      N I   ++ L   +A+   A+  L A   Y RQ  L +   A S++
Sbjct: 101 IDPEQAENQIKEVEATLMELRAQRQQAEAELKLARVTYSRQQRLAQTKAVSQQDLDTAAT 160

Query: 149 XXXXXXXXXXXXXXXIRQSKISINTAESDLGYTRITATMDGTVVAIPVEEGQTVNAAQST 208
                           I++++  S++TA+++L YTRI A M G V  I    +GQTV AAQ
Sbjct: 161 EMAVKQAQIGTIDAQIKRNQASLDTAKTNLDYTRIVAPMAGEVTQITTLQGQTVIAAQQA 220

Query: 209 PTIVQLANLDMMLNKMQIAEGDITKVKAGQDISFTILSEPDTPIKAKLDSVDPGLTTMSS 268
            P I+ LA++  ML K Q++E D+  +K GQ    FT+L +P T  + ++   V P
Sbjct: 221 PNILTLADMSAMLVKAQVSEADVIHLKPGQKAWFTVLGDPLTRYEGQIKDVLP------- 273

Query: 269 GGYNSSTDTASNAVYYYARSFVPNPDGKLATGMTTQNTVEIDGVKNVLLIPSLTVKNRGG 328
            + +  ++A++YYAR  VPNP+G L   MT Q  +++  VKNVL  IP    +  G
Sbjct: 274 -----TPEKVNDAIFYYARFEVPNPNGLLRLDMTAQVHIQLTDVKNVLTIPLSALGDPVG 328

Query: 329 KAFVRV-LGADGKAVEREIRTGMKDSMNTEVKSGLKEGDKVVISE                372
            +V L  +G+  ERE+  G ++  + E+  GL+ GD+VVI E
Sbjct: 329 DNRYKVKLLRNGETREREVTIGARNDTDVEIVKGLEAGDEVVIGE                373
```

Based on this analysis, it was predicted that the proteins from *N. meningitidis* and *N. gonorrhoeae*, and their epitopes, could be useful antigens for vaccines or diagnostics, or for raising antibodies.

ORF85-1 (40.4 kDa) was cloned in the pGex vectors and expressed in *E. coli*, as described above. The products of protein expression and purification were analyzed by SDS-PAGE. FIG. 19A shows the results of affinity purification of the GST-fusion protein. Purified GST-fusion protein was used to immunise mice, whose sera were used for Western blot (FIG. 19B), FACS analysis (FIG. 19C), and ELISA (positive result). These experiments confirm that ORF85-1 is a surface-exposed protein, and that it is a useful immunogen.

Example 92

The following partial DNA sequence was identified in *N. meningitidis* <SEQ ID 773>:

```
  1 ..ATTCCCGCCA CGATGACATT TGAACGCAGC GGCAATGCTT ACAAAATCGT
 51 TTCGACGATT AAAGTGCCGC TATACAATAT CCGTTTCGAG TCCGGCGGTA
101 CGGTTGTCGG CAATACCCTG CACCCTACCT ACTATAGAGA CATACGCAGG
151 GGCAAACTGT ATGCGGAAGc CAAATTCGCC GACgGcAGCG TAACTTACGG
201 CAAAGCGGGC GAGAGCAAAA CCGAGCAAAG CCCCAAGGCT ATGGATTTGT
251 TCACGCTTGC CTGGCAGTTG GCGGCAAATG ACGCGAAACT CCCCCCGGGG
301 CTGAAAATCA CCAACGGCAA AAAACTTTAT TCCGTCGGCG GTTTGAATAA
351 GGCGGGTACA GGAAAATACA GCATAGGCGG CGTGGAAACC GAAGTCGTCA
401 AATATCGGGT GCGGCGCGGC GACGATGCGG TAATGTATTT cTTCGCACCG
451 TCCCTGAACA ATATTCCGGC ACAAATCGGC TATACCGACG ACGGCAAAAC
501 CTATACGCTG AAACTCAAAT CGGTGCAGAT CAACGGCCAG GCAGCCAAAC
551 CGTAA
```

This corresponds to the amino acid sequence <SEQ ID 774; ORF120>:

```
  1 ..IPATMTFERS GNAYKIVSTI KVPLYNIRFE SGGTVVGNTL HPTYYRDIRR

51 GKLYAEAKFA DGSVTYGKAG ESKTEQSPKA MDLFTLAWQL AANDAKLPPG

101 LKITNGKKLY SVGGLNKAGT GKYSIGGVET EVVKYRVRRG DDAVMYFFAP

151 SLNNIPAQIG YTDDGKTYTL KLKSVQINGQ AAKF*
```

Further work revealed the complete nucleotide sequence <SEQ ID 775>:

```
  1 ATGATGAAGA CTTTTAAAAA TATATTTTCC GCCGCCATTT TGTCCGCCGC

51 CCTGCCGTGC GCGTATGCGG CAGGGCTGCC CCAATCCGCC GTGCTGCACT

101 ATTCCGGCAG CTACGGCATT CCCGCCACGA TGACATTTGA ACGCAGCGGC

151 AATGCTTACA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCCAA ATTCGCCGAC

301 GGCAGCGTAA CTTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCGT AA
```

This corresponds to the amino acid sequence <SEQ ID 776; ORF120-1>:

```
  1 MMKTFKNIFS AAILSAALPC AYAAGLPQSA VLHYSGSYGI PATMTFERSG

51 NAYKIVSTIK VPLYNIRFES GGTVVGNTLH PTYYRDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DAVMYFFAPS LNNIPAQIGY

201 TDDGKTYTLK LKSVQINGQA AKP*
```

Computer analysis of this amino acid sequence gave the following results:

Homology with a Predicted ORF from *N. meningitidis* (Strain A)

ORF120 shows 92.4% identity over a 184aa overlap with an ORF (ORF120a) from strain A of *N. meningitidis*:

```
                                             10        20        30
orf120.pep                          IPATMTFERSGNAYKIVSTIKVPLYNIRFE
                                    ||||:|||||||||||||||||||||||||
orf120a    SAAILSAALPCAYAAGLPXSAVLHYSGSYGIPATXXXXXXXNAXKIVSTIKVPLYNIRFE
                   10        20        30        40        50        60
```

-continued

```
                40         50         60         70         80         90
orf120.pep  SGGTVVGNTLHPTYYRDIRRGKLYAEAKFADGSVTYGKAGESKTEQSPKAMDLFTLAWQL
            ||||||||||||||||||||||||||||||||||||||||: |||||||||||||||||||
orf120a     SGGTVVGNTLHPTYYRDIRRGKLYAEAKFADGSVTYGKAXXXXXXXQSPKAMDLFTLAWQL
              70         80         90        100        110        120

100        110        120        130        140        150
orf120.pep  AANDAKLPPGLKITNGKKLYSVGGLNKAGTGKYSIGGVETEVVKYRVRRGDDAVMYFFAP
            ||||||||||||||||||||||||||||||||||||||||||||||||||||||||||||
orf120a     AANDAKLPPGLKITNGKKLYSVGGLNKAGTGKYSIGGVETEVVKYRVRRGDDAVMYFFAP
              130        140        150        160        170        180

160        170        180
orf120.pep  SLNNIPAQIGYTDDGKTYTLKLKSVQINGQAAKPX
            |||||||||||||||||||||||||||||||||||
orf120a     SLNNIPAQIGYTDDGKTYTLKLKSVQINGQAAKPX
              190        200        210        220
```

The complete length ORF120a nucleotide sequence <SEQ ID 777> is:

```
  1 ATGATGAAGA CTTTTAAAAA TATATTTTCC GCCGCCATTT TGTCCGCCGC

51 CCTGCCGTGC GCGTATGCGG CAGGGCTGCC CNAATCCGCC GTGCTGCACT

101 ATTCCGGCAG CTACGGCATT CCCGCCACNA NNANNTNNGN ACNNNGNGNC

151 AATGCTTNCA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCCAA ATTCGCCGAC

301 GGCAGCGTAA CCTACGGCAA AGCGGNNNNN ANCNNNNNNG NGCAAAGCCC

351 CAAGGCTATG GATTTGTTCA CGCTTGCNTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCGT AA
```

This encodes a protein having amino acid sequence <SEQ ID 778>:

```
  1 MMKTFKNIFS AAILSAALPC AYAAGLPXSA VLHYSGSYGI PATXXXXXXX

51 NAXKIVSTIK VPLYNIRFES GGTVVGNTLH PTYYRDIRRG KLYAEAKFAD

101 GSVTYGKAXX XXXXQSPKAM DLFTLAWQLA ANDAKLPPGL KITNGKKLYS

151 VGGLNKAGTG KYSIGGVETE VVKYRVRRGD DAVMYFFAPS LNNIPAQIGY

201 TDDGKTYTLK LKSVQINGQA AKP*
```

ORF120a and ORF120-1 show 93.3% identity in 223 aa overlap:

```
                10         20         30         40         50         60
orf120a.pep  MMKTFKNIFSAAILSAALPCAYAAGLPXSAVLHYSGSYGIPATXXXXXXXNAXKIVSTIK
             ||||||||||||||||||||||||||||| ||||||||||||||:      || ||||||
orf120-1     MMKTFKNIFSAAILSAALPCAYAAGLPQSAVLHYSGSYGIPATMTFERSGNAYKIVSTIK
                 10         20         30         40         50         60
```

```
                          70         80         90        100        110        120
orf120a.pep      VPLYNIRFESGGTVVGNTLHPTYYRDIRRGKLYAEAKFADGSVTYGKAXXXXXXQSPKAM
                 ||||||||||||||||||||||||||||||||||||||||||||||:||||||
orf120-1         VPLYNIRFESGGTVVGNTLHPTYYRDIRRGKLYAEAKFADGSVTYGKAGESKTEQSPKAM
                          70         80         90        100        110        120

130        140        150        160        170        180
orf120a.pep      DLFTLAWQLAANDAKLPPGLKITNGKKLYSVGGLNKAGTGKYSIGGVETEVVKYRVRRGD
                 ||||||||||||||||||||||||||||||||||||||||||||||||||||||||||||
orf120-1         DLFTLAWQLAANDAKLPPGLKITNGKKLYSVGGLNKAGTGKYSIGGVETEVVKYRVRRGD
                         130        140        150        160        170        180

190        200        210        220
orf120a.pep      DAVMYFFAPSLNNIPAQIGYTDDGKTYTLKLKSVQINGQAAKPX
                 |||||||||||||||||||||||||||||||||||||||||||
orf120-1         DAVMYFFAPSLNNIPAQIGYTDDGKTYTLKLKSVQINGQAAKPX
                         190        200        210        220
```

15

Homology with a Predicted ORF from *N. gonorrhoeae*

ORF120 shows 97.8% identity over 184 aa overlap with a predicted ORF (ORF120ng) from *N. gonorrhoeae*:

```
orf120.pep                                    IPATMTFERSGNAYKIVSTIKVPLYNIRFE    30
                                              |||||||||||||||||||||||||||||
orf120ng        SAAILSAALPCAYAARLPQSAVLHYSGSYGIPATMTFERSGNAYKIVSTIKVPLYNIRFE    69 orf120.pep      SGGTVVGNTLHPTYYRDIRRGKLYAEAKFADGSVTYGKAGESKTEQSPKAMDLFTLAWQL    90
                ||||||||||||:|:|||||||||||||||||||||||||||||||||||||||||||||
orf120ng        SGGTVVGNTLHPAYYKDIRRGKLYAEAKFADGSVTYGKAGESKTEQSPKAMDLFTLAWQL   129 orf120.pep      AANDAKLPPGLKITNGKKLYSVGGLNKAGTGKYSIGGVETEVVKYRVRRGDDAVMYFFAP   150
                ||||||||||||||||||||||||||||||||||||||||||||||||||||:||||
orf120ng        AANDAKLPPGLKITNGKKLYSVGGLNKAGTGKYSIGGVETEVVKYRVRRGDDTVTYFFAP   189 orf120.pep      SLNNIPAQIGYTDDGKTYTLKLKSVQINGQAAKP   184
                |||||||||||||||||||||||||||||||||
orf120ng        SLNNIPAQIGYTDDGKTYTLKLKSVQINGQAAKP   223
```

The complete length ORF120ng nucleotide sequence <SEQ ID 779> is:

```
  1 ATGATGAAGA CTTTTAAAAA TATATTTTCC GCCGCCATTT TGTCCGCCGC
 51 CCTGCCGTGC GCGTATGCGG CAAGGCTACC CCAATCCGCC GTGCTGCACT
101 ATTCCGGCAG CTACGGCATT CCCGCCACGA TGACATTTGA ACGCAGCGGC
151 AATGCTTACA AAATCGTTTC GACGATTAAA GTGCCGCTAT ACAATATCCG
201 TTTCGAATCC GGCGGTACGG TTGTCGGCAA TACCCTGCAC CCTGCCTACT
251 ATAAAGACAT ACGCAGGGGC AAACTGTATG CGGAAGCCAA ATTCGCCGAC
301 GGCAGCGTAA CCTACGGCAA AGCGGGCGAG AGCAAAACCG AGCAAAGCCC
351 CAAGGCTATG GATTTGTTCA CGCTTGCCTG GCAGTTGGCG GCAAATGACG
401 CGAAACTCCC CCCGGGTCTG AAAATCACCA ACGGCAAAAA ACTTTATTCC
451 GTCGGCGGCC TGAATAAGGC GGGTACGGGA AAATACAGCA TaggCGGCGT
501 GGAAACCGAA GTCGTCAAAT ATCGGGTGCG GCGCGGCGAC GATACGGTAA
551 CGTATTTCTT CGCACCGTCC CTGAACAATA TTCCGGCACA AATCGGCTAT
601 ACCGACGACG GCAAAACCTA TACGCTGAAG CTCAAATCGG TGCAGATCAA
651 CGGACAGGCC GCCAAACCGT AA
```

This encodes a protein having amino acid sequence <SEQ ID 780>:

```
  1 MMKTFKNIFS AAILSAALPC AYAARLPQSA VLHYSGSYGI PATMTFERSG

51 NAYKIVSTIK VPLYNIRFES GGTVVGNTLH PAYYKDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DTVTYFFAPS LNNIPAQIGY

201 TDDGKTYTLK LKSVQINGQA AKP*
```

In comparison with ORF120-1, ORF120ng shows 97.8% identity in 223 aa overlap:

```
                      10        20        30        40        50        60
     orf120-1.pep  MMKTFKNIFSAAILSAALPCAYAAGLPQSAVLHYSGSYGIPATMTFERSGNAYKIVSTIK
                   ||||||||||||||||||||||||  ||||||||||||||||||||||||||||||||||
     orf120ng      MMKTFKNIFSAAILSAALPCAYAARLPQSAVLHYSGSYGIPATMTFERSGNAYKIVSTIK
                      10        20        30        40        50        60
                      70        80        90       100       110       120
     orf120-1.pep  VPLYNIRFESGGTVVGNTLHPTYYRDIRRGKLYAEAKFADGSVTYGKAGESKTEQSPKAM
                   |||||||||||||||||||||| : :|||||||||||||||||||||||||||||||||
     orf120ng      VPLYNIRFESGGTVVGNTLHPAYYKDIRRGKLYAEAKFADGSVTYGKAGESKTEQSPKAM
                      70        80        90       100       110       120

130       140       150       160       170       180
     orf120-1.pep  DLFTLAWQLAANDAKLPPGLKITNGKKLYSVGGLNKAGTGKYSIGGVETEVVKYRVRRGD
                   ||||||||||||||||||||||||||||||||||||||||||||||||||||||||||||
     orf120ng      DLFTLAWQLAANDAKLPPGLKITNGKKLYSVGGLNKAGTGKYSIGGVETEVVKYRVRRGD
                     130       140       150       160       170       180

190       200       210       220
     orf120-1.pep  DAVMYFFAPSLNNIPAQIGYTDDGKTYTLKLKSVQINGQAAKPX
                   | : ||||||||||||||||||||||||||||||||||||||||
     orf120ng      DTVTYFFAPSLNNIPAQIGYTDDGKTYTLKLKSVQINGQAAKPX
                     190       200       210       220
```

This analysis, including the presence of a putative leader sequence in the gonococcal protein suggests that the proteins from *N. meningitidis* and *N. gonorrhoeae*, and their epitopes, could be useful antigens for vaccines or diagnostics, or for raising antibodies.

Example 93

The following partial DNA sequence was identified in *N. meningitidis* <SEQ ID 781>:

```
  1 ATGTATCGGA GGAAAGGGCG GGGCATCAAG CCGTGGATGG GTGCCGGTGC

51 .GCGTTTGCC GCCTTGGTCT GGCTGGTTTT CGCGCTCGGC GATACTTTGA

101 CTCCGTTTGC GGTTGCGGCG GTGCTGGCGT ATGTATTGGA CCCTTTGGTC

151 GAATGGTTGC AGAAAAAGGG TTTGAACCGT GCATCCGCTT CGATGTCTGT

201 GATGGTGTTT TCCTTGATTT TGTTGTTGGC ATTATTGTTG ATTATCGTCC

251 CTATGCTGGT CGGGCAGTTC AACAATTTGG CATCGCGCCT GCCCCAATTA

301 ATCGGTTTTA TGCAGAACAC GCTGCTGCCG TGGTTGAAAA ATACAATCGG

351 CGGATATGTG GAAATCGATC AGGCATCTAT TATTGCGTGG CTTCAGGCGC

401 ATACGGGAGA GTTGAGCAAC GCGCTTAAGG CGTGGTTTCC CGTTTTGATG

451 AGGCAGGGCG GCAATATT..
```

This corresponds to the amino acid sequence <SEQ ID 782; ORF121>:

```
  1 MYRRKGRGIK PWMGAGXAFA ALVWLVFALG DTLTPFAVAA VLAYVLDPLV
 51 EWLQKKGLNR ASASMSVMVF SLILLLALLL IIVPMLVGQF NNLASRLPQL
101 IGFMQNTLLP WLKNTIGGYV EIDQASIIAW LQAHTGELSN ALKAWFPVLM
151 RQGGNI..
```

Further work revealed the complete nucleotide sequence <SEQ ID 783>:

```
   1 ATGTATCGGA GGAAAGGGCG GGGCATCAAG CCGTGGATGG GTGCCGGTGC
  51 GGCGTTTGCC GCCTTGGTCT GGCTGGTTTT CGCGCTCGGC GATACTTTGA
 101 CTCCGTTTGC GGTTGCGGCG GTGCTGGCGT ATGTATTGGA CCCTTTGGTC
 151 GAATGGTTGC AGAAAAAGGG TTTGAACCGT GCATCCGCTT CGATGTCTCT
 201 GATGGTGTTT TCCTTGATTT TGTTGTTGGC ATTATTGTTG ATTATCGTCC
 251 CTATGCTGGT CGGGCAGTTC AACAATTTGG CATCGCGCCT GCCCCAATTA
 301 ATCGGTTTTA TGCAGAACAC GCTGCTGCCG TGGTTGAAAA ATACAATCGG
 351 CGGATATGTG GAAATCGATC AGGCATCTAT TATTGCGTGG CTTCAGGCGC
 401 ATACGGGAGA GTTGAGCAAC GCGCTTAAGG CGTGGTTTCC CGTTTTGATG
 451 AGGCAGGGCG GCAATATTGT CAGCAGTATC GGCAACCTGC TGCTGCTTCC
 501 CTTGCTGCTT TACTATTTCC TGCTGGATTG GCAGCGGTGG TCGTGCGGCA
 551 TTGCCAAACT GGTTCCGAgG CGTTTTGCCG GTGCTTATAC GCGCATTACA
 601 GGCAATTTGA ACGAGGTATT GGGCGAATTT TGCGCGGGC AGCTTCTGGT
 651 AATGCTGATT ATGGGCTTGG TTTACGGTTT GGGATTGGTG CTGGTCGGGC
 701 TGGATTCGGG GTTTGCCATC GGTATGCTTG CCGGTATTTT GGTGTTTGTC
 751 CCTTATCTCG GGGCGTTTAC GGGATTGCTG CTTGCCACCG TCGCCGCCTT
 801 GCTCCAGTTC GGTTCGTGGA ACGGCATCCT ATCGGTTTGG GCGGTTTTTG
 851 CCGTAGGACA GTTTCTCGAA AGTTTTTTCA TTACGCCCAA AATCGTGGGA
 901 GACCGTATCG GGCTGTCGCC GTTTTGGGTT ATCTTTTCGC TGATGGCGTT
 951 CGGGCAGCTG ATGGGCTTTG TCGGAATGTT GGCGGGATTG CCTTTGGCCG
1001 CCGTAACCTT GGTCTTGCTT CGCGAGGGCG TGCAGAAATA TTTTGCCGCC
1051 AGTTTTTACC GGGGCAGGTA G
```

This corresponds to the amino acid sequence <SEQ ID 784; ORF121-1>:

```
  1 MYRRKGRGIK PWMGAGAAFA ALVWLVFALG DTLTPFAVAA VLAYVLDPLV
 51 EWLQKKGLNR ASASMSVMVF SLILLLALLL IIVPMLVGQE NNLASRLPQL
101 IGFMQNTLLP WLKNTIGGYV EIDQASIIAW LQAHTGELSN ALKAWFPVLM
151 RQGGNIVSSI GNLLLLPLLL YYFLLDWQRW SCGIAKLVPR RFAGAYTRIT
201 GNLNEVLGEF LRGQLLVMLI MGLVYGLGLV LVGLDSGFAI GMLAGILVFV
251 PYLGAFTGLL LATVAALLQF GSWNGILSVW AVFAVGQFLE SFFITPKIVG
```

```
301 DRIGLSPFWV IFSLMAFGQL MGFVGMLAGL PLAAVTLVLL REGVQKYFAG

351 SFYRGR*
```

Computer analysis of this amino acid sequence gave the following results:

Homology with a Predicted ORF from *N. meningitidis* (Strain A)

ORF121 shows 98.7% identity over a 156aa overlap with an ORF (ORF121a) from strain A of *N. meningitidis*:

```
                    10        20        30        40        50        60
    orf121.pep  MYRRKGRGIKPWMGAGXAFAALVWLVFALGDTLTPFAVAAVLAYVLDPLVEWLQKKGLNR
                ||||||||||||||| ||||||||||||||||||||||||||||||||||||||||||||
    orf121a     MYRRKGRGIKPWMDAGAAFAALVWLVFALGDTLTPFAVAAVLAYVLDPLVEWLQKKGLNR
                    10        20        30        40        50        60
                    70        80        90       100       110       120
    orf121.pep  ASASMSVMVFSLILLLALLLIIVPMLVGQFNNLASRLPQLIGFMQNTLLPWLKNTIGGYV
                ||||||||||||||||||||||||||||||||||||||||||||||||||||||||||||
    orf121a     ASASMSVMVFSLILLLALLLIIVPMLVGQFNNLASRLPQLIGFMQNTLLPWLKNTIGGYV
                    70        80        90       100       110       120
                   130       140       150
    orf121.pep  EIDQASIIAWLQAHTGELSNALKAWFPVLMRQGGNI
                ||||||||||||||||||||||||||||||||||||
    orf121a     EIDQASIIAWLQAHTGELSNALKAWFPVLMRQGGNIVSSIGNLLLLPLLLYYFLLDWQRW
                   130       140       150       160       170       180
    orf121a     SCGIAKLVPRRFAGAYTRITGNLNEVLGEFLRGQLLVMLIMGLVYGLGLVLVGLDSGFAI
                   190       200       210       220       230       240
```

The complete length ORF121a nucleotide sequence <SEQ ID 785> is:

```
  1 ATGTATCGGA GGAAAGGGCG GGGCATCAAG CCGTGGATGG ATGCCGGTGC

51 GGCGTTTGCC GCCTTGGTCT GGCTGGTTTT CGCGCTCGGC GATACTTTGA

101 CTCCGTTTGC GGTTGCGGCC GTGCTGGCGT ATGTATTGGA CCCTTTGGTC

151 GAATGGTTGC AGAAAAAGGG TTTGAACCGT GCATCCGCTT CGATGTCTGT

201 GATGGTGTTT TCCTTGATTT TGTTGTTGGC ATTATTGTTG ATTATTGTCC

251 CTATGCTGGT CGGGCAGTTC AACAATTTGG CATCGCGCCT GCCCCAATTA

301 ATCGGTTTTA TGCAGAACAC GCTGCTGCCG TGGTTGAAAA ATACAATCGG

351 CGGATATGTG GAAATCGATC AGGCATCTAT TATTGCGTGG CTTCAGGCGC

401 ATACGGGCGA GTTGAGCAAC GCGCTTAAGG CGTGGTTTCC CGTTTTGATG

451 AGGCAGGGCG GCAATATTGT CAGCAGTATC GGCAACCTGC TGCTGCTTCC

501 CTTGCTGCTT TACTATTTCC TGCTGGATTG GCAGCGGTGG TCGTGCGGCA

551 TTGCCAAACT GGTTCCGAGG CGTTTTGCCG GTGCTTATAC GCGCATTACA

601 GGCAATTTGA ACGAGGTATT GGGCGAATTT TTGCGCGGGC AGCTTCTGGT

651 GATGCTGATT ATGGGTTTGG TTTACGGCTT GGGGTTGGTG CTGGTCGGGC

701 TGGATTCGGG GTTTGCAATC GGTATGGTTG CCGGTATTTT GGTTTTTGTT

751 CCCTATTTGG GCGCGTTTAC AGGACTGCTG CTGGCAACCG TCGCCGCCTT

801 GCTCCAGTTC GGTTCGTGGA ACGGCATCTT GGCTGTTTGG GCGGTTTTTG

851 CCGTAGGACA GTTTCTCGAA AGTTTTTTCA TTACGCCGAA AATCGTGGGA

901 GACCGTATCG GCCTGTCGCC GTTTTGGGTT ATCTTTTCGC TGATGGCGTT
```

```
 951 CGGGCAGCTG ATGGGCTTTG TCGGAATGTT GGCCGGATTG CCTTTGGCCG

1001 CCGTAACCTT GGTCTTGCTT CGCGAGGGCG TGCAGAAATA TTTTGCCGGC

1051 AGTTTTTACC GGGGCAGGTA C
```

This encodes a protein having amino acid sequence <SEQ ID 786>:

```
  1 MYRRKGRGIK PWMDAGAAFA ALVWLVFALG DTLTPFAVAA VLAYVLDPLV

51 EWLQKKGLNR ASASMSVMVF SLILLLALLL IIVPMLVGQF NNLASRLPQL

101 IGFMQNTLLP WLKNTIGGYV EIDQASIIAW LQAHTGELSN ALKAWFPVLM

151 RQGGNIVSSI GNLLLLPLLL YYFLLDWQRW SCGIAKLVPR RFAGAYTRIT

201 GNLNEVLGEF LRGQLLVMLI MGLVYGLGLV LVGLDSGFAI GMVAGILVFV

251 PYLGAFTGLL LATVAALLQF GSWNGILAVW AVFAVGQFLE SFFITPKIVG

301 DRIGLSPFWV IFSLMAFGQL MGFVGMLAGL PLAAVTLVLL REGVQKYFAG

351 SFYRGR*
```

ORF121a and ORF121-1 show 99.2% identity in 356 aa overlap:

```
                    10        20        30        40        50        60
orf121a.pep MYRRKGRGIKPWMDAGAAFAALVWLVFALGDTLTPFAVAAVLAYVLDPLVEWLQKKGLNR
            ||||||||||||||:|||||||||||||||||||||||||||||||||||||||||||||
orf121-1    MYRRKGRGIKPWMGAGAAFAALVWLVFALGDTLTPFAVAAVLAYVLDPLVEWLQKKGLNR
                    10        20        30        40        50        60
                    70        80        90       100       110       120
orf121a.pep ASASMSVMVFSLILLLALLLIIVPMLVGQFNNLASRLPQLIGFMQNTLLPWLKNTIGGYV
            ||||||||||||||||||||||||||||||||||||||||||||||||||||||||||||
orf121-1    ASASMSVMVFSLILLLALLLIIVPMLVGQFNNLASRLPQLIGFMQNTLLPWLKNTIGGYV
                    70        80        90       100       110       120
                   130       140       150       160       170       180
orf121a.pep EIDQASIIAWLQAHTGELSNALKAWFPVLMRQGGNIVSSIGNLLLLPLLLYYFLLDWQRW
            ||||||||||||||||||||||||||||||||||||||||||||||||||||||||||||
orf121-1    EIDQASIIAWLQAHTGELSNALKAWFPVLMRQGGNIVSSIGNLLLLPLLLYYFLLDWQRW
                   130       140       150       160       170       180
                   190       200       210       220       230       240
orf121a.pep SCGIAKLVPRRFAGAYTRITGNLNEVLGEFLRGQLLVMLIMGLVYGLGLVLVGLDSGFAI
            ||||||||||||||||||||||||||||||||||||||||||||||||||||||||||||
orf121-1    SCGIAKLVPRRFAGAYTRITGNLNEVLGEFLRGQLLVMLIMGLVYGLGLVLVGLDSGFAI
                   190       200       210       220       230       240
                   250       260       270       280       290       300
orf121a.pep GMVAGILVFVPYLGAFTGLLLATVAALLQFGSWNGILAVWAVFAVGQFLESFFITPKIVG
            ||:|||||||||||||||||||||||||||||||||||:|||||||||||||||||||||
orf121-1    GMLAGILVFVPYLGAFTGLLLATVAALLQFGSWNGILSVWAVFAVGQFLESFFITPKIVG
                   250       260       270       280       290       300
                   310       320       330       340       350
orf121a.pep DRIGLSPFWVIFSLMAFGQLMGFVGMLAGLPLAAVTLVLLREGVQKYFAGSFYRGRX
            ||||||||||||||||||||||||||||||||||||||||||||||||||||||||
orf121-1    DRIGLSPFWVIFSLMAFGQLMGFVGMLAGLPLAAVTLVLLREGVQKYFAGSFYRGRX
                   310       320       330       340       350
```

Homology with a Predicted ORF from *N. gonorrhoeae*

ORF121 shows 97.4% identity over a 156 aa overlap with a predicted ORF (ORF121ng) from *N. gonorrhoeae*:

```
orf121.pep  MYRRKGRGIKPWMGAGXAFAALVWLVFALGDTLTPFAVAAVLAYVLDPLVEWLQKKGLNR   60
            ||||||||||||||||:|||||||||||:|||||||||||||||||||||||||||||||
orf121ng    MYRRKGRGIKPWMGAGAAFAALVWLVYALGDTLTPFAVAAVLAYVLDPLVEWLQKKGLNR   60
orf121.pep  ASASMSVMVFSLILLLALLLIIVPMLVGQFNNLASRLPQLIGFMQNTLLPWLKNTIGGYV  120
            ||||||||||||||||||||||||||||||||||||||||||||||||||||||||||||
orf121ng    ASASMSVMVFSLILLLALLLIIVPMLVGQFNNLASRLPQLIGFMQNTLLPWLKNTIGGYV  120
```

```
                                             -continued
orf121.pep   EIDQASIIAWLQAHTGELSNALKAWFPVLMRQGGNI                                      156
             |||||||||:|||||||||||||||||||||:||||
orf121ng     EIDQASIIAWFQAHTGELSNALKAWFPVLMKQGGNIVSTIGNLLLPPLLLYYFLLDWHRW              180
```

An ORF121ng nucleotide sequence <SEQ ID 787> was predicted to encode a protein having amino acid sequence <SEQ ID 788>:

```
  1 MYRRKGRGIK PWMGAGAAFA ALVWLVYALG DTLTPFAVAA VLAYVLDPLV

51 EWLQKKGLNR ASASMSVMVF SLILLLALLL IIVPMLVGQF NNLASRLPQL

101 IGFMQNTLLP WLKNTIGGYV EIDQASIIAW FQAHTGELSN ALKAWFPVLM

151 KQGGNIVSTI GNLLLPPLLL YYFLLDWHRW SCGIPKLVPR RFAGAYTRIT

201 GNLNKVWGKF LRGQLLGETE RGAVVCRVGR ECWEGGGARS RPSDDGWPRW

251 GGG*
```

Further work revealed the following gonoccocal DNA sequence <SEQ ID 789>:

```
   1 ATGTATCGGA GAAAAGGACG GGGCATCAAG CCGTGGATGG GTGCCGGCGC

51 GGCGTTTGCC GCCTTGGTCT GGCTGGTTTA CGCGCTCGGC GATACTTTGA

101 CTCCGTTTGC GGTTGCGGCG GTGCTGGCGT ATGTGTTGGA CCCTTTGGTC

151 GAATGGTTGC AGAAAAAGGG TTTGAACCGT GCATCCGCTT CGATGTCTGT

201 GATGGTGTTT TCCTTGATTT TGTTGTTGGC ATTATTGTTG ATTATTGTCC

251 CTATGCTGGT CGGGCAGTTC AATAATTTGG CATCTCGCCT GCCCCAATTA

301 ATCGGTTTTA TGCAGAACAC GCTGCTGCCG TGGTTGAAAA ATACAATCGG

351 CGGATATGTG GAAATCGATC AGGCATCTAT TATTGCGTGG TTTCAGGCGC

401 ATACGGGCGA GTTGAGCAAC GCGCTTAAGG CGTGGTTTCC CGTTTTGATG

451 AAACAGGGCG GCAATATTGT CAGCAGTATC GGCAACCTGC TGCTGCCGCC

501 CTTGCTGCTT TACTATTTCC TGCTGGATTG GCAGCGGTGG TCGTGCGGCA

551 TCGCCAAACT GGTTCCGAGG CGTTTTGCCG GTGCTTATAC GCGCATTACG

601 GGTAATTTGA ACGAGGTATT GGGCGAATTT TTGCGCGGTC AGCTTCTGGT

651 GATGCTGATT ATGGGCTTGG TTTACGGTTT GGGATTGATG CTAGTCGGAC

701 TGGATTCGGG ATTTGCCATC GGTATGGTTG CCGGTATTTT GGTGTTTGTC

751 CCCTATTTGG GTGCGTTTAC GGGATTGCTG CTTGCCACTG TTGCAGCCTT

801 GCTCCAGTTC GGTTCGTGGA ACGGAATCTT GGCTGTTTGG GCGGTTTTTG

851 CCGTCGGTCA GTTTCTCGAA AGTTTTTTCA TTACGCCGAA AATTGTAGGA

901 GACCGTATCG GCCTGTCGCC GTTTTGGGTT ATCTTTTCGC TGATGGCGTT

951 CGGAGAGCTG ATGGGCTTTG TCGGAATGTT GGCCGGATTG CCTTTGGCCG

1001 CCGTAACCTT GGTCTTGCTT CGCGAGGGCG CGCAGAAATA TTTTGCCGGC

1051 AGTTTTTACC GGGGCAGGTA G
```

This corresponds to the amino acid sequence <SEQ ID 790; ORF121ng-1>:

```
  1 MYRRKGRGIK PWMGAGAAFA ALVWLVYALG DTLTPFAVAA VLAYVLDPLV

51 EWLQKKGLNR ASASMSVMVF SLILLLALLL IIVPMLVGQF NNLASRLPQL

101 IGFMQNTLLP WLKNTIGGYV EIDQASIIAW FQAHTGELSN ALKAWFPVLM

151 KQGGNIVSSI GNLLLPPLLL YYFLLDWQRW SCGIAKLVPR RFAGAYTRIT

201 GNLNEVLGEF LRGQLLVMLI MGLVYGLGLM LVGLDSGFAI GMVAGILVFV

251 PYLGAFTGLL LATVAALLQF GSWNGILAVW AVFAVGQFLE SFFITPKIVG

301 DRIGLSPFWV IFSLMAFGEL MGFVGMLAGL PLAAVTLVLL REGAQKYFAG

351 SFYRGR*
```

ORF121ng-1 and ORF121-1 show 97.5% identity in 356 aa overlap:

```
                     10         20         30         40         50         60
       orf121-1.pep  MYRRKGRGIKPWMGAGAAFAALVWLVFALGDTLTPFAVAAVLAYVLDPLVEWLQKKGLNR
                     |||||||||||||||||||||||||||:||||||||||||||||||||||||||||||||
         orf121ng-1  MYRRKGRGIKPWMGAGAAFAALVWLVYALGDTLTPFAVAAVLAYVLDPLVEWLQKKGLNR
                     10         20         30         40         50         60
                     70         80         90        100        110        120
       orf121-1.pep  ASASMSVMVFSLILLLALLLIIVPMLVGQFNNLASRLPQLIGFMQNTLLPWLKNTIGGYV
                     ||||||||||||||||||||||||||||||||||||||||||||||||||||||||||||
         orf121ng-1  ASASMSVMVFSLILLLALLLIIVPMLVGQFNNLASRLPQLIGFMQNTLLPWLKNTIGGYV
                     70         80         90        100        110        120
                    130        140        150        160        170        180
       orf121-1.pep  EIDQASIIAWLQAHTGELSNALKAWFPVLMRQGGNIVSSIGNLLLLPLLLYYFLLDWQRW
                     ||||||||||:|||||||||||||||||||:|||||||||||||| ||||||||||||||
         orf121ng-1  EIDQASIIAWFQAHTGELSNALKAWFPVLMKQGGNIVSSIGNLLLPPLLLYYFLLDWQRW
                    130        140        150        160        170        180
                    190        200        210        220        230        240
       orf121-1.pep  SCGIAKLVPRRFAGAYTRITGNLNEVLGEFLRGQLLVMLIMGLVYGLGLVLVGLDSGFAI
                     |||||||||||||||||||||||||||||||||||||||||||||||||:||||||||||
         orf121ng-1  SCGIAKLVPRRFAGAYTRITGNLNEVLGEFLRGQLLVMLIMGLVYGLGLMLVGLDSGFAI
                    190        200        210        220        230        240
                    250        260        270        280        290        300
       orf121-1.pep  GMLAGILVFVPYLGAFTGLLLATVAALLQFGSWNGILSVWAVFAVGQFLESFFITPKIVG
                     ||:||||||||||||||||||||||||||||||||||:||||||||||||||||||||||
         orf121ng-1  GMVAGILVFVPYLGAFTGLLLATVAALLQFGSWNGILAVWAVFAVGQFLESFFITPKIVG
                    250        260        270        280        290        300
                    310        320        330        340        350
       orf121-1.pep  DRIGLSPFWVIFSLMAFGQLMGFVGMLAGLPLAAVTLVLLREGVQKYFAGSFYRGRX
                     ||||||||||||||||||:|||||||||||||||||||||||:|||||||||||||
         orf121ng-1  DRIGLSPFWVIFSLMAFGELMGFVGMLAGLPLAAVTLVLLREGAQKYFAGSFYRGRX
                    310        320        330        340        350
```

In addition, ORF121ng-1 shows homology to a permease from *H. influenzae*:

```
sp|P43969|PERM_HAEIN PUTATIVE PERMEASE PERM HOMOLOG Length = 349
Score = 69.9 bits (168), Expect = 2e-11
Identities = 67/317 (21%), Positives = 120/317 (37%), Gaps = 7/317 (2%)

Query:  26 VYALGDTLTPFAVAAVLAYVLDPLVEWL-QKKGLNRASASMSVMVFSXXXXXXXXXXXXVP   84
           +Y  GD + P  +A VL+Y+L+   +L Q     R A++ +                 VP
```

```
                              -continued
Sbjct:  32 IYFFGDLIAPLLIALVLSYLLEIPINFLNQYLKCPRMLATILIFGSFIGLAAVFFLVLVP   91

Query:  85 MLVGQFNNLASRLPQLIGFMQNTLLPWLKNTIGGYVE-IDQASIIAWFQAHTGELSNALK  143
           ML  Q  +L S LP +     N    WL N      Y E ID + + + F +   ++      +
Sbjct:  92 MLWNQTISLLSDLPAMF----NKSNEWLLNLPKNYPELIDYSMVDSIFNSVREKILGFGE  147

Query: 144 AWFPVLMKQGGNIVSSIGNXXXXXXXXXXXXXXDWQRSCGIAKLVPRRFAGAYTRITGNL  203
             +   + +    N+VS                D      G+++ +P+    A+ R      +
Sbjct: 148 SAVKLSLASIMNLVSLGIYAFLVPLMMFFMLKDKSELLQGVSRFLPKNRNLAFXRWK-EM  206

Query: 204 NEVLGEFLRGQXXXXXXXXXXXXXXXXXXXXXXDSGFAIGMVAGILVFVPYXXXXXXXXXXX  263
             + +   ++ G+                           +      +    G+ V VPY
Sbjct: 207 QQQISNYIHGKLLEILIVTLITYIIFLIFGLNYPLLLAFAVGLSVLVPYIGAVIVTIPVA  266

Query: 264 XXXXXQFGSWNGILAVWAVFAVGQFLESFFITPKIVGDRIGLSPFWVIFSLMAFGELMGF  323
                  QFG        +    FAV Q L+    + P +   + + L P  +I S++ FG L GF
Sbjct: 267 LVALFQFGISPTFWYIIIAFAVSQLLDGNLLVPYLFSEAVNLHPLIIIISVLIFGGLWGF  326

Query: 324 VGMLAGLPLAAVTLVLL                                             340
             G+    +PLA +    ++
Sbjct: 327 WGVFFAIPLATLVKAVI                                             343
```

Based on this analysis, including the presence of a putative leader sequence and transmembrane domains in the two proteins, it is predicted that the proteins from *N. meningitidis* and *N. gonorrhoeae*, and their epitopes, could be useful antigens for vaccines or diagnostics, or for raising antibodies.

Example 94

The following partial DNA sequence was identified in *N. meningitidis* <SEQ ID 791>:

```
  1..ACTGCTTTTT CGGCGGCGCT GCGCTTGAGT CCATCATGAC TCGTCATATT
 51   TTTGTCCTTT GGGAAACCGT ATCAACAAAC AGCCGCCATC TTAACATTTT
101   TTTGCACGTC CTGCCCGCCG CGTTCAAATG CGTACCAGCA ATACCGCCGC
151   CTGCGCCTCT ATGCCTTCCA TCCGCCCGAG ATAGCCGAGT TTTTCGTTGG
201   TTTTGCCTTT GATGTTGACG CACGAAATGT CTATGCCCAA ATCGGCGGCG
251   ATGTTGGCAC GCATTTGCGG AATGTGCGGC GCGAGTGTGG GTTTCTGTGC
301   AATCACGGTC GTATCGACAT TGACCGCCTG CCAACCCTGC GCCTGAACGC
351   TTTGATACGC CGCACGCAAA AGGACGCGGC TGTCCGCATC TTTGAACTCT
401   GCGGCGGTGT CGGGGAAATG GCTGCCGATA TCGCCCAAAC CTGCCGCACC
451   GAGCAGCGCG TCGGTAACGG CGTGCAGCAG CGCATCGGCA TCCGAGTGTC
501   CGAGCAGCCC TTTTTCAAAT GGGATTTCAA CTCCGCCAAG TATCAG..
```

This corresponds to the amino acid sequence <SEQ ID 792; ORF122>:

```
  1..TAFSAALRLS PSXLVIFLSF GKPYQQTAAI LTFFCTSCPP RSNAYQQYRR
 51   LRLYAFHPPE IAEFFVGFAF DVDARNVYAQ IGGDVGTHLR NVRRECGFLC
101   NHGRIDIDRL PTLRLNALIR RTQKDAAVRI FELCGGVGEM AADIAQTCRT
151   EQRVGNGVQQ RIGIGVSEQP FFKWDFNSAK YQ..
```

Further work revealed the complete nucleotide sequence <SEQ ID 793>:

```
  1 ATATCGTACT GGGCAAGCAG TTCGCCGGAT TTTTTGGAAG TAGATACCGC
 51 GCCTTTGATT TTTTTGCCGC TCTTACCCAA GGCTTCGATG AAAAAGTTGA
101 TGGTCGAGCC GGTACCGATG CCGATATATT CATTTTCGGG TACGAATTCG
151 ACTGCTTTTT CGGCGGCGAT GCGCTTGAGT TCGTCTTGTG TCGTCATATT
201 TTTGTCCTTT GGGAAACCGT ATCAACAAAC AGCCGCCATC TTAACATTTT
251 TTTGCACGTC CTGCCCGCCG CGTTCAAATG CGTACCAGCA ATACCGCCGC
301 CTGCGCCTCT ATGCCTTCCA TCCGCCCGAG ATAGCCGAGT TTTTCGTTGG
351 TTTTGCCTTT GATGTTGACG CACGAAATGT CTATGCCCAA ATCGGCGGCG
401 ATGTTGGCAC GCATTTGCGG AATGTGCGGC GCGAGTTTGG GTTTCTGTGC
451 AATCACGGTC GTATCGACAT TGACCGCCTG CCAACCCTGC GCCTGAACGC
501 TTTGATACGC CGCACGCAAA AGGACGCGGC TGTCCGCATC TTTGAACTCT
551 GCGGCGGTGT CGGGGAAATG GCTGCCGATA TCGCCCAAAC CTGCCGCACC
601 GAGCAGCGCG TCGGTAACGG CGTGCAGCAG CGCATCGGCA TCGGAGTGTC
651 CGAGCAGCCC TTTTTCAAAT GGGATTTCAA CTCCGCCAAG TATCAGCTTT
701 CTGCCTTCGG TCAGTTGGTG GACATCGTAG CCCTGTCCGA TACGGATGTT
751 CGTCATCGTT TGTGTTCCTG A
```

This corresponds to the amino acid sequence <SEQ ID 794; ORF122-1>:

```
  1 ISYWASSSPD FLEVDTAPLI FLPLLPKASM KKLMVEPVPM PIYSFSGTNS
 51 TAFSAAMRLS SSCVVIFLSF GKPYQQTAAI LTFFCTSCPP RSNAYQQYRR
101 LRLYAFHPPE IAEFFVGFAF DVDARNVYAQ IGGDVGTHLR NVRREFGFLC
151 NHGRIDIDRL PTLRLNALIR RTQKDAAVRI FELCGGVGEM AADIAQTCRT
201 EQRVGNGVQQ RIGIGVSEQP FFKWDFNSAK YQLSAFGQLV DIVALSDTDV
251 RHRLCS*
```

Computer analysis of this amino acid sequence gave the following results:

Homology with a Predicted ORF from *N. meningitidis* (Strain A)

ORF122 shows 94.0% identity over a 182aa overlap with an ORF (ORF122a) from strain A of *N. meningitidis*:

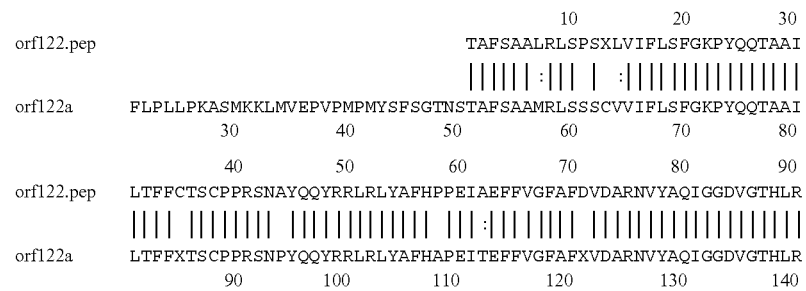

```
                    100        110        120        130        140        150
orf122.pep  NVRRECGFLCNHGRIDIDRLPTLRLNALIRRTQKDAAVRIFELCGGVGEMAADIAQTCRT
            |:|||||||||||||||||||||||||||||||||||||||||||||||||||||||||
orf122a     NMRREFGFLCNHGRIDIDRLPTLRLNALIRRTQKDAAVRIFELCGGVGEMAADIAQTCRT
                    150        160        170        180        190        200

160        170        180
orf122.pep  EQRVGNGVQQRIGIGVSEQPFFKWDFNSAKYQ
            ||||||||||||||||||||||||||||||||
orf122a     EQRVGNGVQQRIGIGVSEQPFFKWDFNSAKYQLSAFGQLVDIVALSDTDVRHRLCSX
                    210        220        230        240        250
```

The complete length ORF122a nucleotide sequence <SEQ ID 795> is:

```
  1 ATATCATATT GGGCAAGCAG TTCACTGGAT TTTTTGGAAG TAGATACCGC
 51 GCCTTTGATT TTTTTGCCGC TCTTACCCAA GGCTTCGATG AAAAAGTTGA
101 TGGTCGAACC GGTACCGATG CCGATGTATT CGTTTTCGGG TACGAATTCG
151 ACTGCNTTTT CGGCGGCGAT GCGCTTGAGT TCGTCTTGTG TCGTCATATT
201 TTTGTCCTTT GGGAAACCGT ATCAACAAAC AGCCGCCATC TTAACATTTT
251 TTNNNACGTC CTGCCCGCCG CGTTCAAATC CTTACCAGCA ATACCGCCGC
301 CTGCGACTCT ATGCCTTCCA TGCGCCCGAG ATAACCGAGT TTTTCGTTGG
351 TTTTGCCTTT GANGTTGACG CACGAAATGT CTATGCCCAA ATCGGCGGCG
401 ATGTTGGCAC GCATTTGCGG AATATGCGGC GCGAGTTTGG GTTTCTGTGC
451 AATCACGGTC GTATCGACAT TGACCGCCTG CCAACCCTGC GCCTGAACGC
501 TTTGATACGC CGCACGCAAA AGGACGCGGC TGTCCGCATC TTTGAACTCT
551 GCGGCGGTGT CGGGGAAATG GCTGCCGATA TCGCCCAAAC CTGCCGCACC
601 GAGCAGCGCG TCGGTAACGG CGTGCAGCAG CGCATCGGCA TCGGACTGTC
651 CGAGCAGCCC TTTTTCAAAT GGGATTTCAA CTCCGCCAAG TATCAGCTTT
701 CTGCCTTCGG TCAGTTGGTC GACATCGTAG CCCTGTCCGA TACGGATGTT
751 CGTCATCGTT TGTGTTCCTG A
```

This encodes a protein having amino acid sequence <SEQ ID 796>:

```
  1 ISYWASSSLD FLEVDTAPLI FLPLLPKASM KKLMVEPVPM PMYSFSGTNS
 51 TAFSAAMRLS SSCVVIFLSF GKPYQQTAAI LTFFXTSCPP RSNPYQQYRR
101 LRLYAFHAPE ITEFFVGFAF XVDARNVYAQ IGGDVGTHLR NMRREFGFLC
151 NHGRIDIDRL PTLRLNALIR RTQKDAAVRI FELCGGVGEM AADIAQTCRT
201 EQRVGNGVQQ RIGIGVSEQP FFKWDFNSAK YQLSAFGQLV DIVALSDTDV
251 RHRLCS*
```

ORF122a and ORF122-1 show 96.9% identity in 256 aa overlap:

```
                  10         20         30         40         50         60
orf122a.pep  ISYWASSSLDFLEVDTAPLIFLPLLPKASMKKLMVEPVPMPMYSFSGTNSTAFSAAMRLS
             |||||||| ||||||||||||||||||||||||||||||:||||||||||||||||||||
orf122-1     ISYWASSSPDFLEVDTAPLIFLPLLPKASMKKLMVEPVPMPIYSFSGTNSTAFSAAMRLS
                  10         20         30         40         50         60

70         80         90        100        110        120
orf122a.pep  SSCVVIFLSFGKPYQQTAAILTFFXTSCPPRSNPYQQYRRLRLYAFHAPEITEFFVGFAF
             ||||||||||||||||||||||| ||||||| |||||||||||||| :||||||||
orf122-1     SSCVVIFLSFGKPYQQTAAILTFFCTSCPPRSNAYQQYRRLRLYAFHPPEIAEFFVGFAF
                  70         80         90        100        110        120

130        140        150        160        170        180
orf122a.pep  XVDARNVYAQIGGDVGTHLRNMRREFGFLCNHGRIDIDRLPTLRLNALIRRTQKDAAVRI
              ||||||||||||||||||||:|||||||||||||||||||||||||||||||||||||
orf122-1     DVDARNVYAQIGGDVGTHLRNVRREFGFLCNHGRIDIDRLPTLRLNALIRRTQKDAAVRI
                 130        140        150        160        170        180

190        200        210        220        230        240
orf122a.pep  FELCGGVGEMAADIAQTCRTEQRVGNGVQQRIGIGVSEQPFFKWDFNSAKYQLSAFGQLV
             ||||||||||||||||||||||||||||||||||||||||||||||||||||||||||||
orf122-1     FELCGGVGEMAADIAQTCRTEQRVGNGVQQRIGIGVSEQPFFKWDFNSAKYQLSAFGQLV
                 190        200        210        220        230        240

250
orf122a.pep  DIVALSDTDVRHRLCSX
             |||||||||||||||||
orf122-1     DIVALSDTDVRHRLCSX
                 250
```

Homology with a Predicted ORF from *N. gonorrhoeae*
ORF122 shows 89.6% identity over a 182 aa overlap with a predicted ORF (ORF122ng) from *N. gonorrhoeae*:

```
orf122.pep                           TAFSAALRLSPSXLVIFLSFGKPYQQTAAI   30
                                     ||||||:||| | :||||||||||||||||
orf122ng     FLPLLPKASMKKLMVEPVPMPMYSFSGTNSTAFSAAMRLSSSCVVIFLSFGKPYQQTAAI   80
orf122.pep   LTFFCTSCPPRSNAYQQYRRLRLYAFHPPEIAEFFVGFAFDVDARNVYAQIGGDVGTHLR   90
             ||||||  ||||  |||||||||||||||||||||||||||:||||: :||||||||||
orf122ng     LTFFCTSWPPRSNPYQQYRRLRLYAFHPPEIAEFFVGFAFDIDARNIDTQIGGDVGTHLR  140
orf122.pep   NVRRECGFLCNHGRIDIDRLPTLRLNALIRRTQKDAAVRIFELCGGVGEMAADIAQTCRT  150
             ||| | |||||||||||||:||||||||||||||||||||||||||||:||||:||||||
orf122ng     NVRCEFGFLCNHGRIDIDHLPTLRLNALIRRTQKDAAVRIFELCGGVGKMAADVAQTCRT  200
orf122.pep   EQRVGNGVQQRIGIGVSEQPFFKWDFNSAKYQ                             182
             ||||||||||||:|| : |||||||||||||||
orf122ng     EQRVGNGVQQRVGIRMPEQPFFKWDFNSAKYQLSAFGQLVDIVALSDTDIRHRLCS     256
```

The complete length ORF122ng nucleotide sequence <SEQ ID 797> is:

```
  1 ATGTCGTACC GGGCAAGCAG TTCGCCGGAT TTTTTGGAGG TTGAAACCGC

51 GCCTTTGATT TTTTACCGC TTTTGCCCAA GGCTTCGATG AAGAAATTGa 101 tgGTCGAACC GgtaCCGATG CCGATGTATT CGTTTTCGGG TACGAATTCG 151 ACTGCTTTTT CGGCGGCGAT GCGCttgAgt TCgtcttgcg TcgTCATATT
```

```
201 TTTAtcctttt gGGAAaccct atcaAcaAAc agccgccatC TTAACATTTT
251 TTTGCACGtc ctggccgccg cgttcaAATc cgtaccaGca ataccgccgc
301 ctgcgcctCT AtgcCTTCCA TCCGCCCGAG ATAGCCGAGT TTTTCGTTGG
351 TTTTGCCTTT GATatTGACG CACGAAATAT CGatacCCAa atcggcgGCG
401 ATGTTGGCAC GCATTTGCGG AATGTGCGGT GCGAGTTTGG GTTTCTGTGC
451 AATCACGGTC GTATCGACAT TGACCACCTG CCAACCCTGC GCCTGAACGC
501 TTTGATACGC CGCACGCAAA AGGACGCGGC TGTCCGCATC TTTGAACTCT
551 GCGGCGGTGT CGGGAAAATG GCTGCCGATG TCGCCCAAAC CTGCCGCACC
601 GAGCAGCgcg tcggtaaCGG CGTGCAGCAG cgcgTcgGCA TCCGAATGCC
651 CGAGCAGCCC TTTTTCAAAT GGGATTTCAA CTCCGCCAAG TATCAGCTTT
701 CTGCCTTCGG TCAATTGGTG GACATCGTAG CCCTGTCCGA TACGGATATT
751 CGTCATCGTT TGTGTTCCTG A
```

This encodes a protein having amino acid sequence <SEQ ID 798>:

```
  1 MSYRASSSPD FLEVETAPLI FLPLLPKASM KKLMVEPVPM PMYSFSGTNS
 51 TAFSAAMRLS SSCVVIFLSF GKPYQQTAAI LTFFCTSWPP RSNPYQQYRR
101 LRLYAFHPFE IAEFFVGFAF DIDARNIDTQ IGGDVGTHLR NVRCEFGFLC
151 NHGRIDIDHL PTLRLNALIR RTQKDAAVRI FELCGGVGKM AADVAQTCRT
201 EQRVGNGVQQ RVGIRMPEQP FFKWDFNSAK YQLSAFGQLV DIVALSDTDI
251 RHRLCS*
```

ORF122ng and ORF122-1 show 92.6% identity in 256 aa overlap:

```
                     10         20         30         40         50         60
orf122-2.pep  ISYWASSSPDFLEVDTAPLIFLPLLPKASMKKLMVEPVPMPIYSFSGTNSTAFSAAMRLS
              :|| |||||||||:||||||||||||||||||||||||||| :||||||||||||||||
orf122ng      MSYRASSSPDFLEVETAPLIFLPLLPKASMKKLMVEPVPMPMYSFSGTNSTAFSAAMRLS
                     10         20         30         40         50         60

70         80         90        100        110        120
orf122-2.pep  SSCVVIFLSFGKPYQQTAAILTFFCTSCPPRSNAYQQYRRLRLYAFHPPEIAEFFVGFAF
              |||||||||||||||||||||||||| ||||| ||||||||||||||||||||||||||
orf122ng      SSCVVIFLSFGKPYQQTAAILTFFCTSWPPRSNPYQQYRRLRLYAFHPPEIAEFFVGFAF
                     70         80         90        100        110        120

130        140        150        160        170        180
orf122-2.pep  DVDARNVYAQIGGDVGTHLRNVRREFGFLCNHGRIDIDRLPTLRLNALIRRTQKDAAVRI
              |:|||: :||||||||||||||| |||||||||||||:||||||||||||||||||||
orf122ng      DIDARNIDTQIGGDVGTHLRNVRCEFGFLCNHGRIDIDHLPTLRLNALIRRTQKDAAVRI
                    130        140        150        160        170        180
                    190        200        210        220        230        240
orf122-2.pep  FELCGGVGEMAADIAQTCRTEQRVGNGVQQRIGIGVSEQPFFKWDFNSAKYQLSAFGQLV
              ||||||||:||||:|||||||||||||||||: : |||||||||||||||||||||||
orf122ng      FELCGGVGKMAADVAQTCRTEQRVGNGVQQRVGIRMPEQPFFKWDFNSAKYQLSAFGQLV
                    190        200        210        220        230        240
```

```
orf122-2.pep    DIVALSDTDVRHRLCSX
                         250
                |||||||||:|||||||
orf122ng        DIVALSDTDIRHRLCSX
                         250
```

Based on this analysis, it is predicted that the proteins from *N. meningitidis* and *N. gonorrhoeae*, and their epitopes, could be useful antigens for vaccines or diagnostics, or for raising antibodies.

Example 95

The following partial DNA sequence was identified in *N. meningitidis* <SEQ ID 799>:

```
  1..GCCGGCGCGA GTGCGAACAA CATTTCCGCG CGTTTTGCGG AAACACCCGT

51   CGCTGTCAGC GTTACCCTGA TCGGCACGGT ACTTGCCGTC ATGCTGCCCG

101   TTACCGAATA TGAAAACTTC CTGCTGCTTA TCGGCTCGGT ATTTGCGCCG

151   ATGGGGCGGA TTTTGATTGC CGACTTTTTC GTCTTGAAAC GGCGTGA
```

This corresponds to the amino acid sequence <SEQ ID 800; ORF125>:

```
  1  . . . AGASANNISA RFAETPVAVS VTLIGTVLAV
         MLPVTEYENF LLLIGSVFAP

51  MGGFDCRLFR LETA*
```

Further work revealed the complete nucleotide sequence <SEQ ID 801>:

```
   1  ATGTCGGGCA ATGCCTCCTC TCCTTCATCT TCCTCCGCCA
      TCGGGCTGAT

51  TTGGTTCGGC GCGGCGGTAT CGATTGCCGA AATCAGCACG
      GGTACGCTGC

101  TTGCGCCTTT GGGCTGGCAG CGCGGTCTGG CGGCTCTACT
      TTTGGGTCAT

151  GCCGTCGGCG GCGCGCTGTT TTTTGCGGCG GCGTATATCG
      GCGCACTGAC

201  CGGACGCAGC TCGATGGAAA GCGTGCGCCT GTCGTTCGGC
      AAACGCGGTT

251  CAGTGCTGTT TTCCGTGGCG AATATGCTGC AACTGGCCGG
      CTGGACGGCG

301  GTGATGATTT ACGCCGGCGC AACGGTCAGC TCCGCTTTGG
      GCAAAGTGTT

351  GTGGGACGGC GAATCTTTTG TCTGGTGGGC ATTGGCAAAC
      GGCGCGCTGA

401  TTGTGCTGTG GCTGGTTTTC GGCGCACGCA AAACAGGCGG
      GCTGAAAACC

451  GTTTCGATGC TGCTGATGCT GTTGGCGGTT CTGTGGCTGA
      GTGCCGAAGT

501  CTTTTCCACG GCAGGCAGCA CCGCCGCACA GGTTTCAGAC
      GGCATGAGTT

551  TCGGAACGGC AGTCGAGCTG TCCGCCGTGA TGCCGCTTTC
      CTGGCTGCCG

601  CTTGCCGCCG ACTACACGCG CCACGCGCGC CGCCCGTTTG
      CGGCAACCCT

651  GACGGCAACG CTCGCCTACA CGCTGACCGG CTGCTGGATG
      TATGCCTTGG

701  GTTTGGCAGC GGCGTTGTTC ACCGGAGAAA CCGACGTGGC
      AAAAATCCTG

751  CTGGGCGCAG GTTTGGGTGC GCCAGGCATT TTGGCGGTCG
      TCCTCTCCAC

801  CGTTACCACA ACGTTTCTCG ATGCCTATTC CGCCGGCGCG
      AGTGCGAACA

851  ACATTTCCGC GCGTTTTGCG GAAACACCCG TCGCTGTCGG
      CGTTACCCTG

901  ATCGGCACGG TACTTGCCGT CATGCTGCCC GTTACCGAAT
      ATGAAAACTT

951  CCTGCTGCTT ATCGGCTCGG TATTTGCGCC GATGGCGGCG
      GTTTTGATTG

1001  CCGACTTTTT CGTCTTGAAA CGGCGTGAGG AGATTGAAGG
      CTTTGACTTT

1051  GCCGGACTGG TTCTGTGGCT TGCGGGCTTC ATCCTCTACC
      GCTTCCTGCT

1101  CTCGTCCGGC TGGGAAAGCA GCATCGGTCT GACCGCCCCC
      GTAATGTCTG

1151  CCGTTGCCAT TGCCACCGTA TCGGTACGCC TTTTCTTTAA
      AAAAACCCAA

1201  TCTTTACAAA GGAACCCGTC ATGA
```

This corresponds to the amino acid sequence <SEQ ID 802; ORF125-1>:

```
  1  MSGNASSPSS SSAIGLIWFG AAVSIAEIST GTLLAPLGWQ
     RGLAALLLGH

51  AVGGALFFAA AYIGALTGRS SMESVRLSFG KRGSVLFSVA
     NMLQLAGWTA
```

-continued

```
101 VMIYAGATVS SALGKVLWDG ESFVWWALAN GALIVLWLVF
    GARKTGGLKT

151 VSMLLMLLAV LWLSAEVFST AGSTAAQVSD GMSFGTAVEL
    SAVMPLSWLP

201 LAADYTRHAR RPFAATLTAT LAYTLTGCWM YALGLAAALF
    TGETDVAKIL

251 LGAGLGAAGI LAVVLSTVTT TFLDAYSAGA SANNISARFA
    ETPVAVGVTL

301 IGTVLAVMLP VTEYENFLLL IGSVFAPMAA VLIADFFVLK
    RREEIEGFDF

351 AGLVLWLAGF ILYRFLLSSG WESSIGLTAP VMSAVAIATV
    SVRLFFKKTQ

401 SLQRNPS*
```

Computer analysis of this amino acid sequence gave the following results:

Homology with a Predicted ORF from *N. meningitidis* (Strain A)

ORF125 shows 76.5% identity over a 51aa overlap with an ORF (ORF125a) from strain A of *N. meningitidis*:

```
                             10            20           30
orf125.pep           AGASANNISARFAETPVAVSVTLIGTVLAV
                     ||:||||||:::| |:||:| :::||:|||
orf125a  KILLGAGLGAAGILAVVLSTVTTTFLDAYSAGVSANNISAKLSEIPIAVAVAVVGTLLAV
         250       260       270       280       290       300
                40            50            60
orf125.pep  MLPVTEYENFLLLIGSVFAPMGGFDCRLFRLETAX
            :|||||||||||||||||||||||          :
orf125a     LLPVTEYENFLLLIGSVFAPMAAVLIADFFVLKRREEIEG
            310       320       330       340
```

The ORF125a partial nucleotide sequence <SEQ ID 803> is:

```
  1 ATGTCGGGCA ATGCCTCCTC TCNTTCATCT TCCGCCGCCA
    TCGGGCTGAT

51 TTGGTTCGGC GCGGCGGTAT CGATTGCCGA AATCAGCACG
    GGTACACTGC

101 TTGCGCCTTT GGGCTGGCAG CGCGGTCTGG CNGCTCTGCT
    TTTGGGTCAT

151 GCCGTCGGCG GCGCGCTGTT TTTTGCGGCG GCGTATATCG
    GCGCACTGAC

201 CGGACNCANC TCGATGGAAA GCGTGCGCCT GTCGTTCGGC
    AAACGCGGTT

251 CAGTGCTGTT TTCCGTGGCG AATATGCTGC AACTGGCCGG
    CTGGACGGCG

301 GTGATGATTT ACGCCGGCGC AACGGTCAGC TCCGCTTTGG
    GCAAAGTGTT

351 GTGGGACGGC GAATCTTTTG TCTGGTGGGC ATTGGCAAAC
    GGCGCGCTGA

401 TTGTGCTGTG GCTGGTTTTC GGCGCACGCA AAACAGGCGG
    GCTGAAAACC

451 GTTTCGATGC TGCTGATGCT GTTGGCGGTT CTGTGGCTGA
    GTGCCGAANT

501 NTTTTCCACG GCAGGCAGCA CCGCCGCANN GGTNNCAGAC
    GGCATGAGTT

551 TCGGAACGGC AGTCGAGCTG TCCGCCGTNA TGCCGCTTTC
    TTGGCTGCCG

601 CTGGCCGCCG ACTACACGCG CCACGCGCGC CGCCCGTTTG
    CGGCAACCCT

651 GACGGCAACG CTCGCCTACA CGCTGACCGG CTGCTGGATG
    TATGCCTTGG

701 GTTTGGCAGC GGCGTTGTTC ACCGGAGAAA CCGACGTGGC
    AAAAATCCTG

751 CTGGGCGCAG GTTTGGGTGC GGCAGGCATT TTGGCGGTCG
    TCCTGTCGAC

801 CGTTACCACC ACTTTTCTCG ATGCNTACTC CGCCGGCGTA
    AGTGCCAACA

851 ATATTTCCGC CAAACTTTCG GAAATACCNA TCGCCGTTGC
    CGTCGCCGTT

901 GTCGGCACAC TGCTTGCCGT CCTCCTGCCC GTTACCGAAT
    ATGAAAACTT

951 CCTGCTGCTT ATCGGCTCGG TATTTGCGCC GATGGCGGCG
    GTTTTGATTG

1001 CCGACTTTTT CGTCTTGAAA CGGCGTGAGG AGATTGAAGG
     C . . .
```

This encodes a protein having the partial amino acid sequence <SEQ ID 804>:

```
  1 MSGNASSXSS SAAIGLIWFG AAVSIAEIST GTLLAPLGWQ
    RGLAALLLGH

51 AVGGALFFAA AYIGALTGXX SMESVRLSFG KRGSVLFSVA
    NMLQLAGWTA

101 VMIYAGATVS SALGKVLWDG ESFVWWALAN GALIVLWLVF
    GARKTGGLKT

151 VSMLLMLLAV LWLSAEXFST AGSTAAXVXD GMSFGTAVEL
    SAVMPLSWLP

201 LAADYTRHAR RPFAATLTAT LAYTLTGCWM YALGLAAALF
    TGETDVAKIL
```

```
251 LGAGLGAAGI LAVVLSTVTT TFLDAYSAGV SANNISAKLS
    EIPIAVAVAV

301 VGTLLAVLLP VTEYENFLLL IGSVFAPMAA VLIADFFVLK
    RREEIEG . . .
```

ORF125a and ORF125-1 show 94.5% identity in 347 aa overlap:

```
                   10         20         30         40         50         60
orf125a.pep   MSGNASSXSSSAAIGLIWFGAAVSIAEISTGTLLAPLGWQRGLAALLLGHAVGGALFFAA
              |||||||  |||:||||||||||||||||||||||||||||||||||||||||||||||
orf125-1      MSGNASSPSSSAIGLIWFGAAVSIAEISTGTLLAPLGWQRGLAALLLGHAVGGALFFAA
                   10         20         30         40         50         60

70         80         90        100        110        120
orf125a.pep   AYIGALTGXXSMESVRLSFGKRGSVLFSVANMLQLAQWTAVMIYAGATVSSALGKVLWDG
              ||||||||  ||||||||||||||||||||||||||||||||||||||||||||||||||
orf125-1      AYIGALTGRSSMESVRLSFGKRGSVLFSVANMLQLAQWTAVMIYAGATVSSALGKVLWDG
                   70         80         90        100        110        120

130        140        150        160        170        180
orf125a.pep   ESFVWWALANGALIVLWLVFGARKTGGLKTVSMLLMLLAVLWLSAEXFSTAGSTAAXVXD
              |||||||||||||||||||||||||||||||||||||||||||||| ||||||||| | |
orf125-1      ESFVWWALANGALIVLWLVFGARKTGGLKTVSMLLMLLAVLWLSAEVFSTAGSTAAQVSD
                  130        140        150        160        170        180

190        200        210        220        230        240
orf125a.pep   GMSFGTAVELSAVMPLSWLPLAADYTRHARRPFAATLTATLAYTLTGCWMYALGLAAALF
              ||||||||||||||||||||||||||||||||||||||||||||||||||||||||||||
orf125-1      GMSFGTAVELSAVMPLSWLPLAADYTRHARRPFAATLTATLAYTLTGCWMYALGLAAALF
                  190        200        210        220        230        240

250        260        270        280        290        300
orf125a.pep   TGETDVAKILLGAGLGAAGILAVVLSTVTTTFLDAYSAGVSANNISAKLSEIPIAVAVAV
              ||||||||||||||||||||||||||||||||||||||:||||||:::| |:||:|:::
orf125-1      TGETDVAKILLGAGLGAAGILAVVLSTVTTTFLDAYSAGASANNISARFAETPVAVGVTL
                  250        260        270        280        290        300

310        320        330        340
orf125a.pep   VGTLLAVLLPVTEYENFLLLIGSVFAPMAAVLIADFFVLKRREEIEG
              :||:|||:||||||||||||||||||||||||||||||||||||||
orf125-1      IGTVLAVMLPVTEYENFLLLIGSVFAPMAAVLIADFFVLKRREEIEGFDFAGLVLWLAGF
                  310        320        330        340        350        360
```

Homology with a Predicted ORF from *N. gonorrhoeae*

ORF125 shows 86.2% identity over a 65aa overlap with a predicted ORF (ORF125ng) from *N. gonorrhoeae*:

```
orf125.pep              AGASANNISARFAETPVAVSVTLIGTVLAV       30
                        |||||||||||| ||||:|||| |||||
orf125ng    KILLGAGLGITGILAVVLSTVTTTFLDTYSAGASANNISARFAEIPVAVGVTLIRTVLAV  308 orf125.pep  MLPVTEYENFLLLIGSVFAPM-GGFDCRLFRLETA                           64
            ||||||| :|||||| ||:|| |||||||| |:||
orf125ng    MLPVTEYKNFLLLIRSVFGPMAGGFDCRLFCLKTA                          343
```

An ORF125ng nucleotide sequence <SEQ ID 805> was predicted to encode a protein having amino acid sequence <SEQ ID 806>:

```
  1 MSGNASSPSS SAAIGLVWFG AAVSIAEIST GTLLAPLGWQ
    RGLAALLLGH

51 AVGGALFFAA AYIGALTGRS SMESVRLSFG KCGSVLFSVA
    NMLQLAGWTA

101 VMIYVGATVS SALGKVLWDG ESFVWWALAN GALIVLWLVF
    GARRTGGLKT

151 VSMLLMLLAV LWLSVEVFAS SGTNAAPAVS DGMTFGTAVE
    LSAVMPLSWL

201 PLAADYTRQA RRPFAATLTA TLAYTLTGCW MYALGLAAAL
    FTGETDVAKI
```

```
251 LLGAGLGITG ILAVVLSTVT TTFLDTYSAG ASANNISARF
    AEIPVAVGVT

301 LIRTVLAVML PVTEYKNFLL LIRSVFGPMA GGFDCRLFCL
    KTA*
```

Further work revealed the following gonococcal DNA sequence <SEQ ID 807>:

```
   1 ATGTCGGGCA ATGCCTCCTC TCCTTCATCT TCCGCCGCCA
     TCGGGCTGGT

51 TTGGTTCGGC GCGGCGGTAT CGATTGCCGA AATCAGCACG
     GGTACGCTGC

101 TCGCCCCCTT GGGCTGGCAG CGCGGTCTGG CGGCCCTGCT
     TTTGGGTCAT

151 GCCGTCGGCG GCGCGCTGTT TTTTGCGGCG GCGTATATCG
     GCCCACTGAC

201 CGGACGCAGC TCGATGGAAA GTGTGCGCCT GTCGTTCGGC
     AAATGCGGTT

251 CAGTGCTGTT TTCCGTGGCG AATATGCTGC AACTGGCCGG
     CTGGACGGCC

301 GTGATGATTT ACGTCGGCGC AACGGTCAGC TCCGCTTTGG
     GCAAAGTGTT

351 GTGGGACGGC GAATCCTTTG TCTGGTGGGC ATTGGCAAAC
     GGCGCACTGA

401 TCGTGCTGTG GCTGGTTTTC GGCGCACGCA GAACGGGCGG
     GCTGAAAACC

451 GTTTCGATGC TGCTGATGCT GCTTGCCGTG TTGTGGTTGA
     GCGTCGAAGT

501 GTTCGCTTCG TCCGGCACAA ACGCCGCGCC CGCCGTTTCA
     GACGGCATGA

551 CCTTCGGAAC GGCAGTCGAA CTGTCCGCCG TCATGCCGCT
     TTCCTGGCTG

601 CCGCTGGCCG CCGACTACAC GCGCCAAGCA CGCCGCCCGT
     TTGCGGCAAC

651 CCTGACGGCA ACGCTCGCCT ATACGCTGAC GGGCTGCTGG
     ATGTATGCCT

701 TGGGTTTGGC GGCGGCTCTG TTTACCGGAG AAACCGACGT
     GGCGAAAATC

751 CTGTTGGGCG CGGGCTTGGG CATAACGGGC ATTCTGGCAG
     TCGTCCTCTC

801 CACCGTTACC ACAACGTTTC TCGATACCTA TTCCGCCGGC
     GCGAGTGCGA

851 ACAACATTTC CGCGCGTTTT GCGGAAATAC CCGTCGCTGT
     CGGCGTTACC

901 CTGATCGGCA CGGTGCTTGC CGTCATGCTG CCCGTTACCG
     AATATAAAAA
```

```
 951 CTTCCTGCTG CTTATCGGCT CGGTATTTGC GCCGATGGCG
     GCGGTTTTGA

1001 TTGCCGACTT TTTCGTCTTA AAACGGCGTG AGGAGATTGA
     AGGCTTTGAC

1051 TTTGCCGGAC TGGTTCTGTG GCTGGCAGGC TTCATCCTCT
     ACCGCTTCCT

1101 GCTCTCGTCC GGTTGGGAAA GCAGCATCGG TCTGACCGCC
     CCCGTAATGT

1151 CTGCCGTTGC CATTGCCACC GTATCGGTAC GCCTTTTCTT
     TAAAAAAACC

1201 CAATCTTTAC AAAGGAACCC GTCATGA
```

This corresponds to the amino acid sequence <SEQ ID 808; ORF125ng-1>:

```
   1 MSGNASSPSS SAAIGLVWFG AAVSIAEIST GTLLAPLGWQ
     RGLAALLLGH

51 AVGGALFFAA AYIGALTGRS SMESVRLSFG KCGSVLFSVA
     NMLQLAGWTA

101 VMIYVGATVS SALGKVLWDG ESFVWWALAN GALIVLWLVF
     GARRTGGLKT

151 VSMLLMLLAV LWLSVEVFAS SGTNAAPAVS DGMTFGTAVE
     LSAVMPLSWL

201 PLAADYTRQA RRPFAATLTA TLAYTLTGCW MYALGLAAAL
     FTGETDVAKI

251 LLGAGLGITG ILAVVLSTVT TTFLDTYSAG ASANNISARF
     AEIPVAVGVT

301 LIGTVLAVML PVTEYKNFLL LIGSVFAPMA AVLIADFFVL
     KRREEIEGFD

351 FAGLVLWLAG FILYRFLLSS GWESSIGLTA PVMSAVAIAT
     VSVRLFFKKT

401 QSLQRNPS*
```

ORF125ng-1 and ORF125-1 show 95.1% identity in 408 aa overlap:

```
                    10        20        30        40        50        60
orf125-1.pep  MSGNASSPSSSSAIGLIWFGAAVSIAEISTGTLLAPLGWQRGLAALLLGHAVGGALFFAA
              ||||||||||  ||||:||||||||||||||||||||||||||||||||||||||||||
orf125ng-1    MSGNASSPSSSAIGLVWFGAAVSIAEISTGTLLAPLGWQRGLAALLLGHAVGGALFFAA
                    10        20        30        40        50        60
```

```
                                70         80         90        100        110        120
orf125-1.pep    AYIGALTGRSSMESVRLSFGKRGSVLFSVANMLQLAGWTAVMIYAGATVSSALGKVLWDG
                ||||||||||||||||||||| |||||||||||||||||||||||:||||||||||||||
orf125ng-1      AYIGALTGRSSMESVRLSFGKCGSVLFSVANMLQLAGWTAVMIYVGATVSSALGKVLWDG
                                70         80         90        100        110        120
                               130        140        150        160        170        179
orf125-1.pep    ESFVWWALANGALIVLWLVFGARKTGGLKTVSMLLMLLAVLWLSAEVFSTAGSTAAQ-VS
                |||||||||||||||||||||||:||||||||||||||||||||||:|||:::|::||  ||
orf125ng-1      ESFVWWALANGALIVLWLVFGARRTGGLKTVSMLLMLLAVLWLSVEVFASSGTNAAPAVS
                               130        140        150        160        170        180
                180        190        200        210        220        230        239
orf125-1.pep     DGMSFGTAVELSAVMPLSWLPLAADYTRHARRPFAATLTATLAYTLTGCWMYALGLAAAL
                 |||:||||||||||||||||||||||||:|||||||||||||||||||||||||||||
orf125ng-1       DGMTFGTAVELSAVMPLSWLPLAADYTRQARRPFAATLTATLAYTLTGCWMYALGLAAAL
                               190        200        210        220        230        240
                240        250        260        270        280        290        299
orf125-1.pep     FTGETDVAKILLGAGLGAAGILAVVLSTVTTTFLDAYSAGASANNISARFAETPVAVGVT
                 |||||||||||||||||:|||||||||||||||||:||||||||||||||||| ||||||
orf125ng-1       FTGETDVAKILLGAGLGITGILAVVLSTVTTTFLDTYSAGASANNISARFAEIPVAVGVT
                               250        260        270        280        290        300
                300        310        320        330        340        350        359
orf125-1.pep     LIGTVLAVMLPVTEYENFLLLIGSVFAPMAAVLIADFFVLKRREEIEGFDFAGLVLWLAG
                 |||||||||||||||:||||||||||||||||||||||||||||||||||||||||||
orf125ng-1       LIGTVLAVMLPVTEYKNFLLLIGSVFAPMAAVLIADFFVLKRREEIEGFDFAGLVLWLAG
                               310        320        330        340        350        360
                360        370        380        390        400
orf125-1.pep     FILYRFLLSSGWESSIGLTAPVMSAVAIATVSVRLFFKKTQSLQRNPSX
                 ||||||||||||||||||||||||||||||||||||||||||||||||
orf125ng-1       FILYRFLLSSGWESSIGLTAPVMSAVAIATVSVRLFFKKTQSLQRNPSX
                               370        380        390        400
```

Based on this analysis, including the presence of putative leader sequence and transmembrane domains in the gonococcal protein, it is predicted that the proteins from *N. meningitidis* and *N. gonorrhoeae*, and their epitopes, could be useful antigens for vaccines or diagnostics, or for raising antibodies.

Example 96

The following partial DNA sequence was identified in *N. meningitidis* <SEQ ID 809>:

```
  1 ATGACCCGTA TCGCCATCCT CGGCGGCGGC CTCTCGGGAA
    GGCTGACCGC
 51 GTTGCAGCTT GCAGAACAAG GTTATCAGAT TGCACTTTTC
    GATAAAAGCT
101 GCCGCCGGGG CGAACACGCC GCCGCCTATG TAGCCGCCGC
    CATGCTCGCG
151 CCTGCAGCGG A.ACGGTCGA AGCCACGCCC GAAGTGGTCA
    GGCTGGGCAG
201 GCAGAGCATC CCGCTTTGGC GCGGCATCCG ATGCCGTCTG
    AACACGCACA
251 CGATGATGCA GGAAAACGGC AGCCTGATTG TATGGCACGG
    GCAGGACAAG
301 CCATTATCCA GCGAGTTCGT CCGCCATCTC AAACGCGGCG
    GCGT.ACGGA
351 TGACGAAATC GTCCGTTGGC GCGCCGACGA CATCGCCGAA
    CGCGAACCGC
401 AACTCGGCGG ACGTTTTTAA GACGGCATCT ACCTGCCGAC
    CGAAGC.CAG
451 CTCGACGGGC GGCAATTATA GTCTGCACTT GCCGACGCTT
    TGGACGAACT
501 GAACGTCCCC TGCCATTGGG AACACGAATG CGTCCCCGAA
    GCCTGCAAG . . .
```

This corresponds to the amino acid sequence <SEQ ID 810; ORF126>:

```
  1 MTRIAILGGG LSGRLTALQL AEQGYQIALF DKSCRRGEHA
    AAYVAAAMLA
 51 PAAXTVEATP EVVRLGRQSI PLWRGIRCRL NTHTMMQENG
    SLIVWHGQDK
101 PLSSEFVRHL KRGGXTDDEI VRWRADDIAE REPQLGCRFX
    DGIYLPTEXQ
151 LDGRQLXSAL ADALDELNVP CHWEHECVPE ACK . . .
```

Further work revealed the complete nucleotide sequence <SEQ ID 811>:

```
  1 ATGACCCGTA TCGCCATCCT CGGCGGCGGC CTCTCGGGAA
    GGCTGACCGC
 51 GTTGCAGCTT GCAGAACAAG GTTATCAGAT TGCACTTTTC
    GATAAAGGCT
```

```
101  GCCGCCGGGG CGAACACGCC GCCGCCTATG TTGCCGCCGC
     CATGCTCGCG

151  CCTGCGGCGG AAGCGGTCGA AGCCACGCCC GAAGTGGTCA
     GGCTGGGCAG

201  GCAGAGCATC CCGCTTTGGC GCGGCATCCG ATGCCGTCTG
     AACACGCACA

251  CGATGATGCA GGAAAACGGC AGCCTGATTG TGTGGCACGG
     GCAGGACAAG

301  CCATTATCCA GCGAGTTCGT CCGCCATCTC AAACGCGGCG
     GCGTAGCGGA

351  TGACGAAATC GTCCGTTGGC GCGCCGACGA CATCGCCGAA
     CGCGAACCGC

401  AACTCGGCGG ACGTTTTTCA GACGGCATCT ACCTGCCGAC
     CGAAGGCCAG

451  CTCGACGGGC GGCAAATATT GTCTGCACTT GCCGACGCTT
     TGGACGAACT

501  GAACGTCCCC TGCCATTGGG AACACGAATG CGTCCCCGAA
     GGCCTGCAAG

551  CCCAATACGA CTGGCTGATC GACTGCCGCG GCTACGGCGC
     AAAAACCGCG

601  TGGAACCAAT CCCCCGAGCA CACCAGCACC CTGCGCGGCA
     TACGCGGCGA

651  AGTGGCGCGG GTTTACACAC CCGAAATCAC GCTCAACCGC
     CCCGTGCGTC

701  TGCTCCATCC GCGTTATCCG CTCTACATCG CCCCGAAAGA
     AAACCACGTC

751  TTCGTCATCG GCGCGACCCA AATCGAAAGC GAAAGCCAAG
     CCCCCGCCAG

801  CGTGCGTTCA GGGTTGGAAC TCTTGTCCGC ACTCTATGCC
     ATCCACCCCG

851  CCTTCGGCGA AGCCGACATC CTCGAAATCG CCACCGGCCT
     GCGCCCCACG

901  CTCAACCACC ACAACCCCGA AATCCGTTAC AACCGCGCCC
     GACGCCTGAT

951  TGAAATCAAC GGCCTTTTCC GCCACGGTTT CATGATCTCC
     CCCGCCGTAA

1001 CCGCCGCCGC CGCCAGATTG GCAGTGGCAC TGTTTGACGG
     AAAAGACGCG

1051 CCCGAACGCG ATAAAGAAAG CGGTTTGGCG TATATCCGAA
     GACAAGATTA

1101 A
```

This corresponds to the amino acid sequence <SEQ ID 812; ORF126-1>:

```
  1 MTRIAILGGG LSGRLTALQL AEQGYQIALF DKGCRRGEHA AAYVAAAMLA
 51 PAAEAVEATP EVVRLGRQSI PLWRGIRCRL NTHTMMQENG SLIVWHGQDK
101 PLSSEFVRHL KRGGVADDEI VRWRADDIAE REPQLGGRFS DGIYLPTEGQ
151 LDGRQILSAL ADALDELNVP CHWEHECVPE GLQAQYDWLI DCRGYGAKTA
201 WNQSPEHTST LRGIRGEVAR VYTPEITLNR PVRLLHPRYP LYIAPKENHV
251 FVIGATQIES ESQAPASVRS GLELLSALYA IHPAFGEADI LEIATGLRPT
301 LNHHNPEIRY NRARRLIEIN GLFRHGFMIS PAVTAAAARL AVALFDGKDA
351 PERDKESGLA YIRRQD*
```

Computer analysis of this amino acid sequence gave the following results:

Homology with a Predicted ORF from *N. meningitidis* (Strain A)

ORF126 shows 90.0% identity over a 180aa overlap with an ORF (ORF126a) from strain A of *N. meningitidis*:

```
                        10         20         30         40         50         60
orf126.pep  MTRIAILGGGLSGRLTALQLAEQGYQIALFDKSCRRGEHAAAYVAAAMLAPAAXTVEATP
            |||||||||||||||||||||||||||||||:||||||||||||||||||||  :|||||
orf126a     MTRIAILGGGLSGRLTALQLAEQGYQIALFDKGCRRGEHAAAYVAAAMLAPAAEAVEATP
                        10         20         30         40         50         60

70         80         90        100        110        120
orf126.pep  EVVRLGRQSIPLWRGIRCRLNTHTMMQENGSLIVWHGQDKPLSSEFVRHLKRGGXTDDEI
            ||||||||:| |||||||| |:|| :|| ||||||||||||||| ||||||||||  :| |
orf126a     EVVRLGRQXIPLWRGIRCHLKTPAMMXENGSLIVWHGQDKPLSNEFVRHLKRGGVADDXI
                        70         80         90        100        110        120
```

```
                         130       140       150       160       170       180
orf126.pep   VRWRADDIAEREPQLGGRFXDGIYLPTEXQLDGRQLXSALADALDELNVPCHWEHECVPE
             ||||||||||||||||||| |||||||| ||||||: ||||||||||||||||||||:||
orf126a      VRWRADDIAEREPQLGGRFSDGIYLPTEGQLDGRQILSALADALDELNVPCHWEHECAPE
                         130       140       150       160       170       180
```

The complete length ORF126a nucleotide sequence <SEQ ID 813> is:

```
   1 ATGACCCGTA TCGCCATCCT CGGCGGCGGC CTCTCNGGAA GGCTGACCGC
  51 ACTGCAGCTT GCAGAACAAG GTTATCAGAT TGCACTTTTC GATAAAGGCT
 101 GCCGCCGGGG CGAACACGCC GCCGCCTATG TTGCCGCCGC CATGCTCGCG
 151 CCTGCGGCGG AAGCGGTCGA AGCCACGCCT GAAGTGGTCA GGCTGGGCAG
 201 GCAGANCATC CCGCTTTGGC GCGGCATCCG ATGCCATCTG AAAACGCCTG
 251 CCATGATGCA NGAAAACGGC AGCCTGATTG TGTGGCACGG GCAGGACAAA
 301 CCTTTATCCA ACGAGTTCGT CCGCCATCTC AAACGCGGCG GCGTAGCGGA
 351 TGACNAAATC GTCCGTTGGC GCGCCGACGA CATCGCCGAA CGCGAACCGC
 401 AACTCGGCGG ACGTTTTTCA GACGGCATCT ACCTGCCGAC CGAAGGCCAG
 451 CTCGACGGGC GGCAAATATT GTCTGCACTT GCCGACGCTT TGGACGAACT
 501 GAACGTCCCC TGCCATTGGG AACACGAATG TGCCCCCGAA GACTTGCAAG
 551 CCCAATACGA CTGGCTGATC GACTGCCGCG GCTACGGCGC AAAAACCGCG
 601 TGGAACCAAT CCCCCGANNA NACCAGCACC CTGCGCGGCA TACGCGGCGA
 651 AGTGGCGCGG GTTTACACAC CCGAAATCAC GCTCAACCGC CCCGTGCGCC
 701 TGCTACACCC GCGCTATCCG CTNTACATCG CCCCGAAAGA AAACCNCGTC
 751 TTCGTCATCG GCGCGACCCA AATCGAAAGC GAAAGCCAAG CACCTGCCAG
 801 CGTGCGTTCC GGGCTGGAAC TCTTATCCGC ACTCTATGCC GTCCACCCCG
 851 CCTTCGGCGA AGCCGACATC CTCGAAATCG CCACCGGCCT GCGCCCCACG
 901 CTCAATCACC ACAACCCCGA AATCCGTTAC AACCGCGCCC GACGCCTGAT
 951 TGAAATCAAC GGCCTTTTCC GCCACGGTTT CATGATCTCC CCCGCCGTAA
1001 CCGCCGCCGC CGTCAGATTG GCAGTGGCAC TGTTTGACGG AAAAGANGCG
1051 CCCGAACGCG ATGAAGAAAG CGGTTTGGCG TATATCCGAA GACAAGATTA
1101 A
```

This encodes a protein having amino acid sequence <SEQ ID 814>:

```
   1 MTRIAILGGG LSGRLTALQL AEQGYQIALF DKGCRRGEHA AAYVAAAMLA
  51 PAAEAVEATP EVVRLGRQXI PLWRGIRCHL KTPAMMXENG SLIVWHGQDK
 101 PLSNEFVRHL KRGGVADDXI VRWRADDIAE REPQLGGRFS DGIYLPTEGQ
 151 LDGRQILSAL ADALDELNVP CHWEHECAPE DLQAQYDWLI DCRGYGAKTA
 201 WNQSPXXTST LRGIRGEVAR VYTPEITLNR PVRLLHPRYP LYIAPKENXV
 251 FVIGATQIES ESQAPASVRS GLELLSALYA VHPAFGEADI LEIATGLRPT
```

-continued

```
301 LNHHNPEIRY NRARRLIEIN GLFRHGFMIS PAVTAAAVRL AVALFDGKXA

351 PERDEESGLA YIRRQD*
```

ORF126a and ORF126-1 show 95.4% identity in 366 aa overlap:

```
                    10         20         30         40         50         60
orf126a.pep  MTRIAILGGGLSGRLTALQLAEQGYQIALFDKGCRRGEHAAAYVAAAMLAPAAEAVEATP
             ||||||||||||||||||||||||||||||||||||||||||||||||||||||||||||
orf126-1     MTRIAILGGGLSGRLTALQLAEQGYQIALFDKGCRRGEHAAAYVAAAMLAPAAEAVEATP
                    10         20         30         40         50         60

70         80         90        100        110        120
orf126a.pep  EVVRLGRQXIPLWRGIRCHLKTPAMMXENGSLIVWHGQDKPLSNEFVRHLKRGGVADDXI
             ||||||||| ||||||||||:|: :|| ||||||||||||||:||||||||||||||| |
orf126-1     EVVRLGRQSIPLWRGIRCRLNTHTMMQENGSLIVWHGQDKPLSSEFVRHLKRGGVADDEI
                    70         80         90        100        110        120

130        140        150        160        170        180
orf126a.pep  VRWRADDIAEREPQLGGRFSDGIYLPTEGQLDGRQILSALADALDELNVPCHWEHECAPE
             |||||||||||||||||||||||||||||||||||||||||||||||||||||||||:||
orf126-1     VRWRADDIAEREPQLGGRFSDGIYLPTEGQLDGRQILSALADALDELNVPCHWEHECVPE
                   130        140        150        160        170        180

190        200        210        220        230        240
orf126a.pep  DLQAQYDWLIDCRGYGAKTAWNQSPXXTSTLRGIRGEVARVYTPEITLNRPVRLLHPRYP
             ||||||||||||||||||||||||| |||||||||||||||||||||||||||||||:||
orf126-1     GLQAQYDWLIDCRGYGAKTAWNQSPEHTSTLRGIRGEVARVYTPEITLNRPVRLLHPRYP
                   190        200        210        220        230        240

250        260        270        280        290        300
orf126a.pep  LYIAPKENXVFVIGATQIESESQAPASVRSGLELLSALYAVHPAFGEADILEIATGLRPT
             |||||||| |||||||||||||||||||||||||||||||:|||||||||||||||||||
orf126-1     LYIAPKENHVFVIGATQIESESQAPASVRSGLELLSALYAIHPAFGEADILEIATGLRPT
                   250        260        270        280        290        300

310        320        330        340        350        360
orf126a.pep  LNHHNPEIRYNRARRLIEINGLFRHGFMISPAVTAAAVRLAVALFDGKXAPERDEESGLA
             ||||||||||||||||||||||||||||||||||||||:|||||||||| ||||:|||||
orf126-1     LNHHNPEIRYNRARRLIEINGLFRHGFMISPAVTAAAARLAVALFDGKDAPERDKESGLA
                   310        320        330        340        350        360 orf126a.pep  YIRRQDX
             |||||||
orf126-1     YIRRQDX
```

Homology with a Predicted ORF from *N. gonorrhoeae*

ORF126 shows 90% identity over a 180 aa overlap with a predicted ORF (ORF126ng) from *N. gonorrhoeae*:

```
orf126.pep  MTRIAILGGGLSGRLTALQLAEQGYQIALFDKSCRRGEHAAAYVAAAMLAPAAXTVEATP   60
            ||||||:|||||||||||||||||||||:||||    |::|||||||||||||| :|||||
orf126ng    MTRIAVLGGGLSGRLTALQLAEQGYQIELFDKGTRQGEHAAAYVAAAMLAPAAEAVEATP   60 orf126.pep  EVVRLGRQSIPLWRGIRCRLNTHTMMQENGSLIVWHGQDKPLSSEFVRHLKRGGXTDDEI  120
            ||:|||||||||||||||||||| ||||||||||||||||||||||||||||||| :|||
orf126ng    EVIRLGRQSIPLWRGIRCRLNTLTMMQENGSLIVWHGQDKPLSSEFVRHLKRGGVADDEI  120 orf126.pep  VRWRADDIAEREPQLGGRFXDGIYLPTEXQLDGRQLXSALADALDELNVPCHWEHECVPE  180
            ||||||:||||||||||||| |||||||:|||||||:|||||||||||||||||||||:|:
orf126ng    VRWRADEIAEREPQLGGRFSDGIYLPTEGQLDGRQILSALADALDELNVPCHWEHECAPQ  180
```

An ORF126ng nucleotide sequence <SEQ ID 815> was predicted to encode a protein having amino acid sequence <SEQ ID 816>:

```
  1 MTRIAVLGGG LSGRLTALQL AEQGYQIELF DKGTRQGEHA AAYVAAAMLA

51 PAAEAVEATP EVIRLGRQSI PLWRGIRCRL NTLTMMQENG SLIVWHGQDK

101 PLSSEFVRHL KRGGVADDEI VRWRADEIAE REPQLGGRFS DGIYLPTEGQ

151 LDGRQILSAL ADALDELNVP CHWEHECAPQ DLQAQYDWVI DCRGYGAKTA

201 WNQSPEHTST LRGIRGEVRG FTRPKSRSTA PCACCTRAIR STSPRKKTTS

251 SSSARPKSKA KAKPPPAYVP GWNSYPRSMP STPPSAKPTS SKWRPGLRPT

301 LNHHNPEIRY SRERRLIEIN GLFRHGFMIS PAVTAAAVRL AVALFDGKDA

351 PERDEESGLA YIGRQD*
```

Further work revealed the following gonococcal DNA sequence <SEQ ID 817>:

```
   1 ATGACCCGTA TCGCCGTCCT CGGAGGCGGC CTTTCCGGAA GGCTGACCGC
  51 ATTGCAGCTT GCAGAACAAG GTTATCAGAT TGAACTTTTC GACAAGGGCA
 101 CCCGCCAAGG CGAACACGCC GCCGCCTATG TTGCCGCCGC GATGCTCGCG
 151 CCTGCGGCGG AAGCGGTCGA GGCAACGCCC GAAGTCATCA GGCTGGGCAG
 201 GCAGAGCATT CCGCTTTGGC GCGGCATCCG ATGCCGTCTG AACACGCTCA
 251 CGATGATGCA GGAAAACGGC AGCCTGATTG TGTGGCACGG GCAGGACAAG
 301 CCATTATCCA GCGAGTTCGT CCGCCATCTC AAACGCGGCG GCGTAGCGGA
 351 TGACGAAATC GTCCGTTGGC GCGCCGATGA AATCGCCGAA CGCGAACCGC
 401 AACTCGGCGG ACGTTTTTCA GACGGCATCT ACCTGCCGAC CGAAGGCCAG
 451 CTCGACGGGC GGCAAATATT GTCTGCACTT GCCGACGCTT TGGACGAACT
 501 GAACGTCCCT TGCCATTGGG AACACGAATG CGCCCCCCAA GACCTGCAAG
 551 CCCAATACGA CTGGGTAATC GACTGCCGGG GCTACGGCGC GAAAACCGCG
 601 TGGAACCAAT CCCCCGAGCA CACCAGCACC TTGCGCGGCA TACGCGGCGA
 651 AGTGGCGCGG GTTTACACGC CGAAATCAC GCTCAACCGC CCCGTGCGCC
 701 TGCTGCACCC GCGCTATCCG CTCTACATCG CCCCGAAAGA AAACCACGTC
 751 TTCGTCATCG GCGCGACCCA AATCGAAAGC GAAAGCCAAG CCCCCGCCAG
 801 CGTACGTTCC GGGCTGGAAC TCTTATCCGC GCTCTATGCC GTCCACCCCG
 851 CCTTCGGCGA AGCCGACATC CTCGAAATCG CCGCCGGCCT GCGCCCCACG
 901 CTCAACCACC ACAACCCCGA AATCCGCTAC AGCCGCGAAC GCCGCCTCAT
 951 CGAAATCAAC GGCCTTTTCC GGCACGGCTT TATGATTTCC CCCGCCGTAA
1001 CCGCCGCCGC CGTCAGATTG GCAGTGGCAC TGTTTGACGG AAAAGACGCG
1051 CCCGAACGTG ATGAAGAAAG CGGTTTGGCG TATATCGGAA GACAAGATTA
1101 A
```

This corresponds to the amino acid sequence <SEQ ID 818; ORF126ng-1>:

```
  1 MTRIAVLGGG LSGRLTALQL AEQGYQIELF DKGTRQGEHA AAYVAAAMLA

51 PAAEAVEATP EVIRLGRQSI PLWRGIRCRL NTLTMMQENG SLIVWHGQDK

101 PLSSEFVRHL KRGGVADDEI VRWRADEIAE REPQLGGRFS DGIYLPTEGQ

151 LDGRQILSAL ADALDELNVP CHWEHECAPQ DLQAQYDWVI DCRGYGAKTA

201 WNQSPEHTST LRGIRGEVAR VYTPEITLNR PVRLLHPRYP LYIAPKENHV

251 FVIGATQIES ESQAPASVRS GLELLSALYA VHPAFGEADI LEIAAGLRPT

301 LNHHNPEIRY SRERRLIEIN GLFRHGFMIS PAVTAAAVRL AVALFDGKDA

351 PERDEESGLA YIGRQD*
```

ORF126ng-1 and ORF126-1 show 95.1% identity in 366 aa overlap:

```
                    10         20         30         40         50         60
orf126-1.pep  MTRIAILGGGLSGRLTALQLAEQGYQIALFDKGCRRGEHAAAYVAAAMLAPAAEAVEATP
              ||||:||||||||||||||||||||||| |||| |:||||||||||||||||||||||||
orf126ng-1    MTRIAVLGGGLSGRLTALQLAEQGYQIELFDKGTRQGEHAAAYVAAAMLAPAAEAVEATP
                    10         20         30         40         50         60

70         80         90        100        110        120
orf126-1.pep  EVVRLGRQSIPLWRGIRCRLNTHTMMQENGSLIVWHGQDKPLSSEFVRHLKRGGVADDEI
              ||:|||||||||||||||||||| |||||||||||||||||||||||||||||||||||
orf126ng-1    EVIRLGRQSIPLWRGIRCRLNTLTMMQENGSLIVWHGQDKPLSSEFVRHLKRGGVADDEI
                    70         80         90        100        110        120

130        140        150        160        170        180
orf126-1.pep  VRWRADDIAEREPQLGGRFSDGIYLPTEGQLDGRQILSALADALDELNVPCHWEHECVPE
              ||||||:|||||||||||||||||||||||||||||||||||||||||||||||||||:|:
orf126ng-1    VRWRADEIAEREPQLGGRFSDGIYLPTEGQLDGRQILSALADALDELNVPCHWEHECAPQ
                   130        140        150        160        170        180

190        200        210        220        230        240
orf126-1.pep  GLQAQYDWLIDCRGYGAKTAWNQSPEHTSTLRGIRGEVARVYTPEITLNRPVRLLHPRYP
              ||||||||:|||||||||||||||||||||||||||||||||||||||||||||||||||
orf126ng-1    DLQAQYDWVIDCRGYGAKTAWNQSPEHTSTLRGIRGEVARVYTPEITLNRPVRLLHPRYP
                   190        200        210        220        230        240

250        260        270        280        290        300
orf126-1.pep  LYIAPKENHVFVIGATQIESESQAPASVRSGLELLSALYAIHPAFGEADILEIATGLRPT
              |||||||||||||||||||||||||||||||||||||||||:||||||||||||:||||
orf126ng-1    LYIAPKENHVFVIGATQIESESQAPASVRSGLELLSALYAVHPAFGEADILEIAAGLRPT
                   250        260        270        280        290        300

310        320        330        340        350        360
orf126-1.pep  LNHHNPEIRYNRARRLIEINGLFRHGFMISPAVTAAAARLAVALFDGKDAPERDKESGLA
              |||||||||:| ||||||||||||||||||||||||:||||||||||||||||:||||
orf126ng-1    LNHHNPEIRYSRERRLIEINGLFRHGFMISPAVTAAAVRLAVALFDGKDAPERDEESGLA
                   310        320        330        340        350        360 orf126-1.pep  YIRRQDX
              || ||||
orf126ng-1    YIGRQDX
```

Furthermore, ORF126ng-1 shows homology to a putative *Rhizobium* oxidase flavoprotein:

```
gi|2627327 (AF004408) putative amino acid oxidase flavoprotein
[Rhizobium etli]
Length = 327
Score = 169 bits (423), Expect = 3e-41
Identities = 112/329 (34%), Positives = 163/329 (49%), Gaps = 25/329 (7%)

Query:    3 RIAVLGGGLSGRLTALQLAEQGYQIELFDKGTRQGEHXXXXXXXXXXXXXXXXXXXXXXX   62
            RI V G G++G   A QL   G+++ L ++    G
Sbjct:    2 RILVNGAGVAGLTVAWQLYRHGFRVTLAERAGTVGA-GASGFAGGMLAPWCERESAEEPV   60

Query:   63 IRLGRQSIPLWRGIRCRLNTLTMMQENGSLIVWHGQDKPLSSEFVRHLKRGGVADDEIVR  122
            + LGR +    W              +  G+L+V G+D    F R   G     DE+
Sbjct:   61 LTLGRLAADWWEAA-----LPGHVHRRGTLVVAGGRDTGELDRFSRRTS-GWEWLDEVA-  113

Query:  123 WRADEIAEREPQLGGRFSDGIYLPTEGQLDGRQILSALADALDELNVPCHWEHECAPQDL  182
                   IA  EP L GRF   ++    E  LD RQ L+ALA  L++  +              +
Sbjct:  114 -----IAALEPDLAGRFRRALFFRQEAHLDPRQALAALAAGLEDARMRLTLG---VVGES  165

Query:  183 QAQYDWVIDCRGYGAKTAWNQSPEHTSTLRGIRGEVARVYTPEITLNRPVRLLHPRYPLY  242
                 +D V+DC G                  LRG+RGE+   V T E++L+RPVRLLHPR+P+Y
Sbjct:  166 DVDHDRVVDCTGAA-------QIGRLPGLRGVRGEMLCVETTEVSLSRPVRLLHPRHPIY  218

Query:  243 IAPKENHVFVIGATQIESESQAPASVRSGLELLSALYAVHPAFGEADILEIAAGLRPTLN  302
            I P++ + F++GAT IES+    P + RS +ELL+A YA+HPAFGEA + E   AG+RP
Sbjct:  219 IVPRDKNRFMVGATMIESDDGGPITARSLMELLNAAYAMHPAFGEARVTETGAGVRPAYP  278

Query:  303 HHNPEIRYSRERRLIEINGLFRHGFMISP                                331
            + P   R ++E R +  +NGL+RHGF+++P
Sbjct:  279 DNLP--RVTQEGRTLHVNGLYRHGFLLAP                                305
```

This analysis suggests that the proteins from *N. meningitidis* and *N. gonorrhoeae*, and their epitopes, could be useful antigens for vaccines or diagnostics, or for raising antibodies.

Example 97

The following DNA sequence, believed to be complete, was identified in *N. meningitidis* <SEQ ID 819>:

```
  1 ATGACTGATA ATCGGGGGTT TACGCTGGTT GAATTAATAT CAGTGGTCTT
 51 GATATTGTCT GTACTTGCTT TAATTGTTTA TCCGAGCTAT CGCAATTATG
101 TTGAGAAAGC AAAGATAAAT GCAGTGCGGG CAGCCTTGTT AGAAAATGCA
151 CATTTTATGG AAAAGTTTTA TCTGCAGAAT GGGAGGTTTA AACAAACATC
201 TACCAAGTGG CCAAGTTTGC CGATTAAAGA GGCAGAAGGC TTTTGTATCC
251 GTTTGAATGG AATCGtCGCG CGGG..GCTT TAGACAGTAA ATTCATGTTG
301 AAGGCGGTAG CCATAGATAA AGATAAAAAT CCTTTTATTA TTAAGATGAA
351 TGAAAATCTA GTAACCTTTA aTTTGCAAGA AGTCCGCCAG TTCGTGTAGT
401 GACGGGCTGG ATTATTTTAA AGGAAATGAT AAGGACTGCA AGTTACTTAA
451 GTAG
```

This corresponds to the amino acid sequence <SEQ ID 820; ORF127>:

```
  1 MTDNRGFTLV ELISVVLILS VLALIVYPSY RNYVEKAKIN AVRAALLENA
 51 HFMEKFYLQN GRFKQTSTKW PSLPIKEAEG FCIRLNGIVA RXALDSKFML
101 KAVAIDKDKN PFIIKMNENL VTFICKKSAS SCSDGLDYFK GNDKDCKLLK
151 *
```

Further work revealed the following DNA sequence <SEQ ID 821>:

```
  1 ATGACTGATA ATCGGGGGTT TACGCTGGTT GAATTAATAT CAGTGGTCTT
 51 GATATTGTCT GTACTTGCTT TAATTGTTTA TCCGAGCTAT CGCAATTATG
101 TTGAGAAAGC AAAGATAAAT GCAGTGCGGG CAGCCTTGTT AGAAAATGCA
151 CATTTTATGG AAAAGTTTTA TCTGCAGAAT GGGAGGTTTA AACAAACATC
201 TACCAAGTGG CCAAGTTTGC CGATTAAAGA GGCAGAAGGC TTTTGTATCC
251 GTTTGAATGG AATCGCGCGC GGGGCTTTAG ACAGTAAATT CATGTTGAAG
301 GCGGTAGCCA TAGATAAAGA TAAAAATCCT TTTATTATTA AGATGAATGA
351 AAATCTAGTA ACCTTTATTT GCAAGAAGTC CGCCAGTTCG TGTAGTGACG
401 GGCTGGATTA TTTTAAAGGA AATGATAAGG ACTGCAAGTT ACTTAAGTAG
```

This corresponds to the amino acid sequence <SEQ ID 822; ORF127-1>:

```
  1 MTDNRGFTLV ELISVVLILS VLALIVYPSY RNYVEKAKIN AVRAALLENA
 51 HFMEKFYLQN GRFKQTSTKW PSLPIKEAEG FCIRLNGIAR GALDSKFMLK
101 AVAIDKDKNP FIIKMNENLV TFICKKSASS CSDGLDYFKG NDKDCKLLK*
```

Computer analysis of this amino acid sequence gave the following results:

Homology with a Predicted ORF from *N. meningitidis* (Strain A)

ORF127 shows 98.0% identity over a 150aa overlap with an ORF (ORF127a) from strain A of *N. meningitidis*:

```
                    10         20         30         40         50         60
   orf127.pep  MTDNRGFTLVELISVVLILSVLALIVYPSYRNYVEKAKINAVRAALLENAHFMEKFYLQN
               ||||||||||||||||||||||||||||||||||||||||:|||||||||||||||||||
   orf127a     MTDNRGFTLVELISVVLILSVLALIVYPSYRNYVEKAKINTVRAALLENAHFMEKFYLQN
                    10         20         30         40         50         60

70         80         90        100        110        120
   orf127.pep  GRFKQTSTKWPSLPIKEAEGFCIRLNGIVARXALDSKFMLKAVAIDKDKNPFIIKMNENL
               |||||||||||||||||||||||||||||| || ||||||||||||||||||||||||||
   orf127a     GRFKQTSTKWPSLPIKEAEGFCIRLNGI-ARGALDSKFMLKAVAIDKDKNPFIIKMNENL
                    70         80         90        100        110

130        140        150
   orf127.pep  VTFICKKSASSCSDGLDYFKGNDKDCKLLKX
               ||||||||||||||||||||||||||||||
   orf127a     VTFICKKSASSCSDGLDYFKGNDKDCKLLKX
                   120        130        140        150
```

The complete length ORF127a nucleotide sequence <SEQ ID 823> is:

```
  1 ATGACTGATA ATCGGGGGTT TACGCTGGTT GAATTAATAT CAGTGGTCTT
 51 GATATTGTCT GTACTTGCTT TAATTGTTTA TCCGAGCTAT CGCAATTATG
101 TTGAGAAAGC AAAGATAAAT ACAGTGCGGG CAGCCTTGTT AGAAAATGCA
```

-continued

```
151 CATTTTATGG AAAAGTTTTA TCTGCAGAAT GGGAGATTTA AACAAACATC
201 TACCAAATGG CCAAGTTTGC CGATTAAAGA GGCAGAAGGC TTTTGTATCC
251 GTTTGAATGG AATCGCGCGC GGGGCCTTAG ACAGTAAATT CATGTTGAAG
301 GCGGTAGCCA TAGATAAAGA TAAAAATCCT TTTATTATTA AGATGAATGA
351 AAATCTAGTA ACCTTTATTT GCAAGAAGTC CGCCAGTTCG TGTAGTGACG
401 GGCTGGATTA TTTTAAAGGA AATGATAAGG ACTGCAAGTT ACTTAAGTAG
```

This encodes a protein having amino acid sequence <SEQ ID 824>:

```
  1 MTDNRGFTLV ELISVVLILS VLALIVYPSY RNYVEKAKIN TVRAALLENA
 51 HFMEKFYLQN GRFKQTSTKW PSLPIKEAEG FCIRLNGIAR GALDSKFMLK
101 AVAIDKDKNP FIIKMNENLV TFICKKSASS CSDGLDYFKG NDKDCKLLK*
```

ORF127a and ORF127-1 show 99.3% identity in 149 aa overlap:

```
                  10        20        30        40        50        60
orf127a.pep  MTDNRGFTLVELISVVLILSVLALIVYPSYRNYVEKAKINTVRAALLENAHFMEKFYLQN
             ||||||||||||||||||||||||||||||||||||||:|||||||||||||||||||||
orf127-1     MTDNRGFTLVELISVVLILSVLALIVYPSYRNYVEKAKINAVRAALLENAHFMEKFYLQN
                  10        20        30        40        50        60
                  70        80        90       100       110       120
orf127a.pep  GRFKQTSTKWPSLPIKEAEGFCIRLNGIARGALDSKFMLKAVAIDKDKNPFIIKMNENLV
             ||||||||||||||||||||||||||||||||||||||||||||||||||||||||||||
orf127-1     GRFKQTSTKWPSLPIKEAEGFCIRLNGIARGALDSKFMLKAVAIDKDKNPFIIKMNENLV
                  70        80        90       100       110       120
                 130       140       150
orf127a.pep  TFICKKSASSCSDGLDYFKGNDKDCKLLKX
             |||||||||||||||||||||||||||||
orf127-1     TFICKKSASSCSDGLDYFKGNDKDCKLLKX
                 130       140       150
```

Homology with a Predicted ORF from *N. gonorrhoeae*

ORF127 shows 97.3% identity over a 150 aa overlap with a predicted ORF (ORF127ng) from *N. gonorrhoeae*:

```
orf127.pep  MTDNRGFTLVELISVVLILSVLALIVYPSYRNYVEKAKINAVRAALLENAHFMEKFYLQN  60
            ||||||||||||||||||||||||||||||||||||||||||:|||||||||||||||||
orf127ng    MTDNRGFTLVELISVVLILSVLALIVYPSYRNYVEKAKINAVRAAFLENAHFMEKFYLQN  60 orf127.pep  GRFKQTSTKWPSLPIKEAEGFCIRLNGIVARXALDSKFMLKAVAIDKDKNPFIIKMNENL  120
            ||||||||||||||||||||||||||||| |:||||||||||||||||||||||||||||
orf127ng    GRFKQTSTKWPSLPIKEAEGFCIRLNGI-ARGALDSKFMLKAVAIDKDKNPFIIKMNENL  119 orf127.pep  VTFICKKSASSCSDGLDYFKGNDKDCKLLK  150
            |||||||||||||||:|||||||||||||
orf127ng    VTFICKKSASSCSDRLDYFKGNDKDCKLLK  149
```

The complete length ORF127ng nucleotide sequence <SEQ ID 825> is:

```
  1 ATGACTGATA ATCGGGGGTT TACACTGGTT GAATTAATAT CAGTGGTCTT
 51 GATATTGTCT GTACTTGCTT TAATTGTTTA TCCGAGCTAT CGCAATTATG
101 TTGAGAAAGC AAAGATAAAT GCAGTGCGGG CAGCCTTGTT AGAAAATGCA
151 CATTTTATGG AAAAGTTTTA TCTGCAGAAT GGGAGATTTA AACAAACATC
201 TACCAAATGG CCAAGTTTGC CGATTAAAGA GGCAGAAGGC TTTTGTATCC
251 GTTTGAATGG AATCGCGCGC GGGGCTTTAG ACAGTAAATT CATGTTGAAG
301 GCGGTAGCCA TAGATAAAGA TAAAAATCCT TTTATTATTA AGATGAATGA
351 AAATCTAGTA ACCTTTATTT GCAAGAAGTC CGCCAGTTCG TGTAGTGACG
401 GGCTGGATTA TTTTAAAGGA AATGATAAGG ACTGCAAGTT ACTTAAGTAG
```

This encodes a protein having amino acid sequence <SEQ ID 826>:

```
  1 MTDNRGFTLV ELISVVLILS VLALIVYPSY RNYVEKAKIN AVRAAFLENA
 51 HFMEKFYLQN GRFKQTSTKW PSLPIKEAEG FCIRLNGIAR GALDSKFMLK
101 AVAIDKDKNP FIIKMNENLV TFICKKSASS CSDRLDYFKG NDKDCKLLK*
```

ORF127ng and ORF127-1 show 100.0% identity in 149 aa overlap:

```
                   10        20        30        40        50        60
   orf127-1.pep   MTDNRGFTLVELISVVLILSVLALIVYPSYRNYVEKAKINAVRAALLENAHFMEKFYLQN
                  ||||||||||||||||||||||||||||||||||||||||||||||||||||||||||||
   orf127ng-1     MTDNRGFTLVELISVVLILSVLALIVYPSYRNYVEKAKINAVRAALLENAHFMEKFYLQN
                   10        20        30        40        50        60

70        80        90       100       110       120
   orf127-1.pep   GRFKQTSTKWPSLPIKEAEGFCIRLNGIARGALDSKFMLKAVAIDKDKNPFIIKMNENLV
                  ||||||||||||||||||||||||||||||||||||||||||||||||||||||||||||
   orf127ng-1     GRFKQTSTKWPSLPIKEAEGFCIRLNGIARGALDSKFMLKAVAIDKDKNPFIIKMNENLV
                   70        80        90       100       110       120

130       140       150
   orf127-1.pep   TFICKKSASSCSDGLDYFKGNDKDCKLLKX
                  |||||||||||||||||||||||||||||
   orf127ng-1     TFICKKSASSCSDGLDYFKGNDKDCKLLKX
                  130       140       150
```

This analysis, including the fact that the predicted transmembrane domain is shared by the meningococcal and gonococcal proteins, suggests that the proteins from *N. meningitidis* and *N. gonorrhoeae*, and their epitopes, could be useful antigens for vaccines or diagnostics, or for raising antibodies.

Example 98

The following partial DNA sequence was identified in *N. meningitidis* <SEQ ID 827>

```
  1 ..GTGTCGCTGG CTTCGGTGAT TGCCTCTCAA ATCTTCCTTT ACGAAGATTT
 51    CAACCAAATG CGGAAAACCC GTGGAGCTAT CTGCGGTTTT CTTGTCCAAT
101    ATTTATCTGG GGTTTCAGCA GGGGTATTTC GATTTGAGTG CCGACGAGAA
```

-continued

```
151  CCCCGTACTG CATATCTGGT CTTTGGCAGT AGAGGAACAG TATTACCTCC

201  TGTATCCCCT TTTGCTGATA TTTTGCTGCA AAAAAACCAA ATCGCTACGG

251  GTGCTGCGTA ACATCAGCAT CATCCTGTTT TTGATTTTGA CTGCCTCATC

301  GTTTTTGCCA AGCGGGTTTT ATACCGACAT CCTCAACCAA CCCAATACTT

351  ATTACCTTTC GACACTGAGG TTTCCCGAGC TGTTGGCAGG TTCGCTGCTG

401  GCGGTTTACG GGCAAACGCA AAACGGCAGA CGGCAAACAG CAAATGGAAA

451  ACGGCAGTTG CTTTCATCAC TCTGCTTCGG CGCATTGCTT GCCTGCCTGT

501  TCGTGATTGA CAAACACAAT CCGTTTATCC CGGGAATGAC CCTGCTCCTT

551  CCCTGCCTGC TGACGGCACT GCTTATCCGG AGTATGCAAT ACGGGACACT

601  TCCGACCCGC ATCCTGTCGG CAAGCCCCAT CGTATTTGTC CGCAAAATCT

651  CTTATTCCCT ATACCTGTAC CATTGGATTT TTATTGCTTT CGCTCCGCTC

701  ATTAGAGGCG GGAAACAGCT CGGACTGCCT GCCG..
```

This corresponds to the amino acid sequence <SEQ ID 828; ORF128>:

```
  1..VSLASVIASQ IFLYEDFNQM RKTVELSAVF LSNIYLGFQQ GYFDLSADEN

51  PVLHIWSLAV EEQYYLLYPL LLIFCCKKTK SLRVLRNISI ILFLILTASS

101  FLPSGFYTDI LNQPNTYYLS TLRFPELLAG SLLAVYGQTQ NGRRQTANGK

151  RQLLSSLCFG ALLACLFVID KHNPFIPGMT LLLPCLLTAL LIRSMQYGTL

201  PTRILSASPI VFVGKISYSL YLYHWIFIAF APLIRGGKQL GLPA..
```
                                                        35

Further work revealed the complete nucleotide sequence <SEQ ID 829>:

```
  1  ATGCAAGCTG TCCGATACAG ACCGGAAATT GACGGATTGC GGGCCGTCGC

51  CGTGCTATCC GTCATGATTT CCACCTGAA TAACCGCTGG CTGCCCGGAG

101  GATTCCTGGG GGTGGACATT TTCTTTGTCA TCTCAGGATT CCTCATTACC

151  GGCATCATTC TTTCTGAAAT ACAGAACGGT TCTTTTTCTT TCCGGGATTT

201  TTATACCCGC AGGATTAAGC GGATTTATCC TGCCTTTATT GCGGCCGTGT

251  CGCTGGCTTC GGTGATTGCC TCTCAAATCT TCCTTTACGA AGATTTCAAC

301  CAAATGCGGA AAACCGTGGA GCTTTCTGCG GTTTTCTTGT CCAATATTTA

351  TCTGGGGTTT CAGCAGGGGT ATTTCGATTT GAGTGCCGAC GAGAACCCCG

401  TACTGCATAT CTGGTCTTTG GCAGTAGAGG AACAGTATTA CCTCCTGTAT

451  CCCCTTTTGC TGATATTTTG CTGCAAAAAA ACCAAATCGC TACGGGTGCT

501  GCGTAACATC AGCATCATCC TGTTTTTGAT TTTGACTGCC TCATCGTTTT

551  TGCCAAGCGG GTTTTATACC GACATCCTCA ACCAACCCAA TACTTATTAC

601  CTTTCGACAC TGAGGTTTCC CGAGCTGTTG CAGGTTCGC TGCTGGCGGT

651  TTACGGGCAA ACGCAAAACG GCAGACGGCA AACAGCAAAT GGAAACGGC

701  AGTTGCTTTC ATCACTCTGC TTCGGCGCAT TGCTTGCCTG CCTGTTCGTG

751  ATTGACAAAC ACAATCCGTT TATCCCGGGA ATGACCCTGC TCCTTCCCTG

801  CCTGCTGACG GCACTGCTTA TCCGCAGTAT GCAATACGGG ACACTTCCGA
```

```
-continued
 851 CCCGCATCCT GTCGGCAAGC CCCATCGTAT TTGTCGGCAA AATCTCTTAT
 901 TCCCTATACC TGTACCATTG GATTTTTATT GCTTTCGCCC ATTACATTAC
 951 AGGCGACAAA CAGCTCGGAC TGCCTGCCGT ATCGGCGGTT GCCGCGTTGA
1001 CGGCCGGATT TTCCCTGTTG AGTTATTATT TGATTGAACA GCCGCTTAGA
1051 AAACGGAAGA TGACCTTCAA AAAGGCATTT TTCTGCCTCT ATCTCGCCCC
1101 GTCCCTGATA CTTGTCGGTT ACAACCTGTA CGCAAGGGGG ATATTGAAAC
1151 AGGAACACCT CCGCCCGTTG CCCGGCGCGC CCCTTGCTGC GGAAAATCAT
1201 TTTCCGGAAA CCGTCCTGAC CCTCGGCGAC TCGCACGCCG GACACCTGAG
1251 GGGGTTTCTG GATTATGTCG GCAGCCGGGA AGGGTGGAAA GCCAAAATCC
1301 TGTCCCTCGA TTCGGAGTGT TTGGTTTGGG TAGATGAGAA GCTGGCAGAC
1351 AACCCGTTAT GTCGAAAATA CCGGGATGAA GTTGAAAAAG CCGAAGCCGT
1401 TTTCATTGCC CAATTCTATG ATTTGAGGAT GGGCGGCCAG CCTGTGCCGA
1451 GATTTGAAGC GCAATCCTTC CTAATACCCG GGTTCCCAGC CCGATTCAGG
1501 GAAACCGTCA AAAGGATAGC CGCCGTCAAA CCCGTCTATG TTTTTGCAAA
1551 CAACACATCA ATCAGCCGTT CGCCCCTGAG GGAGGAAAAA TTGAAAAGAT
1601 TTGCCGCAAA CCAATATCTC CGCCCCATTC AGGCTATGGG CGACATCGGC
1651 AAGAGCAATC AGGCGGTCTT TGATTTGATT AAAGATATTC CCAATGTGCA
1701 TTGGGTGGAC GCACAAAAAT ACCTGCCCAA AAACACGGTC GAAATATACG
1751 GCCGCTATCT TTACGGCGAC CAAGACCACC TGACCTATTT CGGTTCTTAT
1801 TATATGGGGC GGGAATTCCA CAAACACGAA CGCCTGCTTA AATCTTCCCA
1851 CGGCGGCGCA TTGCAGTAG
```

This corresponds to the amino acid sequence <SEQ ID 830; ORF128-1>:

```
  1 MQAVRYRPEI DGLRAVAVLS VMIFHLNNRW LPGGFLGVDI FFVISGFLIT

51 GIILSEIQNG SFSFRDFYTR RIKRIYPAFI AAVSLASVIA SQIFLYEDFN

101 QMRKTVELSA VFLSNIYLGF QQGYFDLSAD ENPVLHIWSL AVEEQYYLLY

151 PLLLIFCCKK TKSLRVLRNI SIILFLILTA SSFLPSGFYT DILNQFNTYY

201 LSTLRFPELL AGSLLAVYGQ TQNGRRQTAN GKRQLLSSLC FGALLACLFV

251 IDKHNPFIPG MTLLLPCLLT ALLIRSMQYG TLPTRILSAS PIVFVGKISY

301 SLYLYHWIFI AFAHYITGDK QLGLPAVSAV AALTAGFSLL SYYLIEQPLR

351 KRRMTEKKAF FCLYLAPSLI LVGYNLYARG ILKQEHLRPL PGAPLAAENH

401 FPETVLTLGD SHAGHLRGFL DYVGSREGWK AKILSLDSEC LVWVDEKLAD

451 NPLCRKYRDE VEKAEAVFIA QFYDLRMGGQ PVPRFEAQSF LIPGFPARFR

501 ETVKRIAAVK PVYVFANNTS ISRSPLREEK LKRFAANQYL RPIQAMGDIG

551 KSNQAVFDLI KDIPNVHWVD AQKYLPKNTV EIYGRYLYGD QDHLTYFGSY

601 YMGREFHKHE RLLKSSHGGA LQ*
```

Computer analysis of this amino acid sequence gave the following results:

Homology with Hypothetical Integral Membrane Protein HI0392 of *H. influenzae* (Accession Number U32723)

ORF128 and HI0392 show 52% aa identity in 180aa overlap:

```
Orf128:   1 VSLASVIASQIFLYEDFNQMRKTVELSAVFLSNIYLGFQQGYFDLSADENPVLHIWSLAV    60
            ++L S IAS IF+Y DFN++RKT+EL+  FLSN YLG  QGYFDLSA+ENPVLHIWSLAV
HI0392:  46 MALVSFIASAIFIYNDFNKLRKTIELAIAFLSNFYLGLTQGYFDLSANENPVLHIWSLAV   105

Orf128:  61 EEQXXXXXXXXXIFCCKKTKSLRVLRNISIILFLILTASSFLPSGFYTDILNQPNTYYLS   120
            E Q         I   KK + ++VL  I++ILF IL A+SF+ +  FY ++L+QPN YYLS
HI0392: 106 EGQYYLIFPLILILAYKKFREVKVLFIITLILFFILLATSFVSANFYKEVLHQPNIYYLS   165

Orf128: 121 TLRFPELLAGSLLAVYGQTQNGRRQTANGKRQLLSSLCFGALLACLFVIDKHNPFIPGMT   180
            LRFPELL GSLLA+Y    N + Q +    +L+ L    L +CLF+++ +  FIPG+T
HI0392: 166 NLRFPELLVGSLLAIYHNLSN-KVQLSKQVNNILAILSTLLLFSCLFLMNNNIAFIPGIT   224
```

Homology with a Predicted ORF from *N. meningitidis* (Strain A)

ORF128 shows 98.0% identity over a 244aa overlap with an ORF (ORF128a) from strain A of *N. meningitidis*:

```
                                                  10        20        30
orf128.pep                                VSLASVIASQIFLYEDFNQMRKTVELSAVF
                                          ||||||||||||||||||||||||||||||
orf128a    ILSEIQNGSFSFRDFYTRRIKRIYPAFIAAVSLASVIASQIFLYEDFNQMRKTVELSAVF
                60        70        80        90       100       110
                   40        50        60        70        80        90
orf128.pep LSNIYLGFQQGYFDLSADENPVLHIWSLAVEEQYYLLYPLLLIFCCKKTKSLRVLRNISI
           ||||||||||||||||||||||||||||||||||||||||||||||||||||||||||||
orf128a    LSNIYLGFQQGYFDLSADENPVLHIWSLAVEEQYYLLYPLLLIFCCKKTKSLRVLRNISI
                  120       130       140       150       160       170
                  100       110       120       130       140       150
orf128.pep ILFLILTASSFLPSGFYTDILNQPNTYYLSTLRFPELLAGSLIAVYGQTQNGRRQTANGK
           ||||||:|||||||||||||||||||||||||||||||||||||||||||||||||||||
orf128a    ILFLILTATSFLPSGFYTDILNQPNTYYLSTLRFPELLAGSLIAVYGQTQNGRRQTANGK
                  180       190       200       210       220       230
                  160       170       180       190       200       210
orf128.pep RQLLSSLCFGALLACLFVIDKHNPFIPGMTLLLPCLLTALLIRSMQYGTLPTRILSASPI
           ||||||||||||||||||||||||||||||||||||||||||||||||||||||||||||
orf128a    RQLLSSLCFGALLACLFVIDKHNPFIPGMTLLLPCLLTALLIRSMQYGTLPTRILSASPI
                  240       250       260       270       280       290
                  220       230       240
orf128.pep VFVGKISYSLYLYHWIFIAFAPLIRGGKQLGLPA
           |||||||||||||||||||||   | ||||||||
orf128a    VFVGKISYSLYLYHWIFIAFAHYITGDKQLGLPAVSAVAALTAGFSLLSYYLIEQPLRKR
                  300       310       320       330       340       350
orf128a    KMTFKKAFFCLYLAPSLILVGYNLYARGILKQEHLRPLPGAPLAAENHFPETVLTLGDSH
                  360       370       380       390       400       410
```

The complete length ORF128a nucleotide sequence <SEQ ID 831> is:

```
  1 ATGCAAGCTG TCCGATACAG ACCGGAAATT GACGGATTGC GGGCCGTCGC

51 CGTGCTATCC GTCATGATTT TCCACCTGAA TAACCGCTGG CTGCCCGGAG

101 GATTCCTGGG GGTGGACATT TTCTTTGTCA TCTCAGGATT CCTCATTACC

151 GGCATCATTC TTTCTGAAAT ACAGAACGGT TCTTTTTCTT TCCGGGATTT

201 TTATACCCGC AGGATTAAGC GGATTTATCC TGCTTTTATT GCGGCCGTGT

251 CGCTGGCTTC GGTGATTGCC TCTCAAATCT TCCTTTACGA AGATTTCAAC

301 CAAATGCGGA AAACCGTGGA GCTTTCTGCG GTTTTCTTGT CCAATATTTA
```

```
                          -continued
 351 TCTGGGGTTT CAGCAGGGGT ATTTCGATTT GAGTGCCGAC GAGAACCCCG

401 TACTGCATAT CTGGTCTTTG GCAGTAGAGG AACAGTATTA CCTCCTGTAT

451 CCTCTTTTGC TGATATTTTG CTGCAAAAAA ACAAAATCGC TACGGGTGCT

501 GCGTAACATC AGCATCATCC TATTTCTGAT TTTGACTGCC ACATCGTTTT

551 TGCCAAGCGG GTTTTATACC GATATTCTCA ACCAACCCAA TACTTATTAC

601 CTTTCGACAC TGAGGTTTCC CGAGCTGTTG GCAGGTTCGC TGCTGGCGGT

651 TTACGGGCAA ACGCAAAACG GCAGACGGCA ACAGCAAAT GGAAAACGGC

701 AGTTGCTTTC ATCACTCTGC TTCGGCGCAT TGCTTGCCTG CCTGTTCGTG

751 ATTGACAAAC ACAATCCGTT TATCCCGGGA ATGACCCTGC TCCTTCCCTG

801 CCTGCTGACG GCACTGCTTA TCCGGAGTAT GCAATACGGG ACACTTCCGA

851 CCCGCATCCT GTCGGCAAGC CCCATCGTAT TTGTCGGCAA AATCTCTTAT

901 TCCCTATACC TGTACCATTG GATTTTTATT GCTTTCGCCC ATTACATTAC

951 AGGCGACAAA CAGCTCGGAC TGCCTGCCGT ATCGGCGGTT GCCGCGTTGA

1001 CGGCCGGATT TTCCCTGTTG AGTTATTATT TGATTGAACA GCCGCTTAGA

1051 AAACGGAAGA TGACCTTCAA AAAGGCATTT TTCTGCCTCT ATCTCGCCCC

1101 GTCCCTGATA CTTGTCGGTT ACAACCTGTA CGCAAGGGGG ATATTGAAAC

1151 AGGAACACCT CCGCCCGTTG CCCGGCGCGC CCCTTGCTGC GGAAAATCAT

1201 TTTCCGGAAA CCGTCCTGAC CCTCGGCGAC TCGCACGCCG ACACCTGCG

1251 GGGGTTTCTG GATTATGTCG GCAGCCGGGA AGGGTGGAAA GCCAAAATCC

1301 TGTCCCTCGA TTCGGAGTGT TTGGTTTGGG TAGATGAGAA GCTGGCAGAC

1351 AACCCGTTAT GTCGAAAATA CCGGGATGAA GTTGAAAAAG CCGAAGCCGT

1401 TTTCATTGCC CAATTCTATG ATTTGAGGAT GGGCGGCCAG CCCGTGCCGA

1451 GATTTGAAGC GCAATCCTTC CTAATACCCG GGTTCCCAGC CCGATTCAGG

1501 GAAACCGTCA AAAGGATAGC CGCCGTCAAA CCCGTCTATG TTTTTGCAAA

1551 CAACACATCA ATCAGCCGTT CGCCCCTGAG GGAGGAAAAA TTGAAAAGAT

1601 TTGCCGCAAA CCAATATCTC CGCCCCATTC AGGCTATGGG CGACATCGGC

1651 AAGAGCAATC AGGCGGTCTT TGATTTGATT AAAGATATTC CAATGTGCA

1701 TTGGGTGGAC GCACAAAAAT ACCTGCCCAA AAACACGGTC GAAATATACG

1751 GCCGCTATCT TTACGGCGAC CAAGACCACC TGACCTATTT CGGTTCTTAT

1801 TATATGGGGC GGGAATTTCA CAAACACGAA CGCCTGCTTA AATCTTCTCG

1851 CGACGGCGCA TTGCAGTAG
```

This encodes a protein having amino acid sequence <SEQ ID 832>:

```
  1 MQAVRYRPEI DGLRAVAVLS VMIFHLNNRW LPGGFLGVDI FFVISGFLIT

51 GIILSEIQNG SFSFRDFYTR RIKRIYPAFI AAVSLASVIA SQIFLYEDFN

101 QMRKTVELSA VFLSNIYLGF QQGYFDLSAD ENPVLHIWSL AVEEQYYLLY

151 PLLLIFCCKK TKSLRVLRNI SIILFLILTA TSFLPSGFYT DILNQPNTYY

201 LSTLRFPELL AGSLLAVYGQ TQNGRRQTAN GKRQLLSSLC FGALLACLFV

251 IDKHNPFIPG MTLLLPCLLT ALLIRSMQYG TLPTRILSAS PIVFVGKISY
```

-continued

```
301 SLYLYHWIFI AFAHYITGDK QLGLPAVSAV AALTAGFSLL SYYLIEQPLR

351 KRKMTFKKAF FCLYLAPSLI LVGYNLYARG ILKQEHLRPL PGAPLAAENH

401 FPETVLTLGD SHAGHLRGFL DYVGSREGWK AKILSLDSEC LVWVDEKLAD

451 NPLCRKYRDE VEKAEAVFIA QFYDLRMGGQ PVPRFEAQSF LIPGFPARFR

501 ETVKRIAAVK PVYVFANNTS ISRSFLREEK LKRFAANQYL RPIQAMGDIG

551 KSNQAVFDLI KDIPNVHWVD AQKYLPKNTV EIYGRYLYGD QDHLTYFGSY

601 YMGREFHKHE RLLKSSRDGA LQ*
```

ORF128a and ORF128-1 show 99.5% identity in 622 aa overlap:

```
orf128a.pep   MQAVRYRPEIDGLRAVAVLSVMIFHLNNRWLPGGFLGVDIFFVISGFLITGIILSEIQNG
              ||||||||||||||||||||||||||||||||||||||||||||||||||||||||||||
orf128-1      MQAVRYRPEIDGLRAVAVLSVMIFHLNNRWLPGGFLGVDIFFVISGFLITGIILSEIQNG
orf128a.pep   SFSFRDFYTRRIKRIYPAFIAAVSLASVIASQIFLYEDFNQMRKTVELSAVFLSNIYLGF
              ||||||||||||||||||||||||||||||||||||||||||||||||||||||||||||
orf128-1      SFSFRDFYTRRIKRIYPAFIAAVSLASVIASQIFLYEDFNQMRKTVELSAVFLSNIYLGF
orf128a.pep   QQGYFDLSADENPVLHIWSLAVEEQYYLLYPLLLIFCCKKTKSLRVLRNISIILFLILTA
              ||||||||||||||||||||||||||||||||||||||||||||||||||||||||||||
orf128-1      QQGYFDLSADENPVLHIWSLAVEEQYYLLYPLLLIFCCKKTKSLRVLRNISIILFLILTA
orf128a.pep   TSFLPSGFYTDILNQPNTYYLSTLRFPELLAGSLLAVYGQTQNGRRQTANGKRQLLSSLC
              :|||||||||||||||||||||||||||||||||||||||||||||||||||||||||||
orf128-1      SSFLPSGFYTDILNQPNTYYLSTLRFPELLAGSLLAVYGQTQNGRRQTANGKRQLLSSLC
orf128a.pep   FGALLACLFVIDKHNPFIPGMTLLLPCLLTALLIRSMQYGTLPTRILSASPIVFVGKISY
              ||||||||||||||||||||||||||||||||||||||||||||||||||||||||||||
orf128-1      FGALLACLFVIDKHNPFIPGMTLLLPCLLTALLIRSMQYGTLPTRILSASPIVFVGKISY
orf128a.pep   SLYLYHWIFIAFAHYITGDKQLGLPAVSAVAALTAGFSLLSYYLIEQPLRKRKMTFKKAF
              ||||||||||||||||||||||||||||||||||||||||||||||||||||||||||||
orf128-1      SLYLYHWIFIAFAHYITGDKQLGLPAVSAVAALTAGFSLLSYYLIEQPLRKRKMTFKKAF
orf128a.pep   FCLYLAPSLILVGYNLYARGILKQEHLRPLPGAPLAAENHFPETVLTLGDSHAGHLRGFL
              ||||||||||||||||||||||||||||||||||||||||||||||||||||||||||||
orf128-1      FCLYLAPSLILVGYNLYARGILKQEHLRPLPGAPLAAENHFPETVLTLGDSHAGHLRGFL
orf128a.pep   DYVGSREGWKAKILSLDSECLVWVDEKLADNPLCRKYRDEVEKAEAVFIAQFYDLRMGGQ
              ||||||||||||||||||||||||||||||||||||||||||||||||||||||||||||
orf128-1      DYVGSREGWKAKILSLDSECLVWVDEKLADNPLCRKYRDEVEKAEAVFIAQFYDLRMGGQ
orf128a.pep   PVPRFEAQSFLIPGFPARFRETVKRIAAVKPVYVFANNTSISRSPLREEKLKRFAANQYL
              ||||||||||||||||||||||||||||||||||||||||||||||||||||||||||||
orf128-1      PVPRFEAQSFLIPGFPARFRETVKRIAAVKPVYVFANNTSISRSPLREEKLKRFAANQYL
orf128a.pep   RPIQAMGDIGKSNQAVFDLIKDIPNVHWVDAQKYLPKNTVEIYGRYLYGDQDHLTYFGSY
              ||||||||||||||||||||||||||||||||||||||||||||||||||||||||||||
orf128-1      RPIQAMGDIGKSNQAVFDLIKDIPNVHWVDAQKYLPKNTVEIYGRYLYGDQDHLTYFGSY
orf128a.pep   YMGREFHKHERLLKSSRDGALQX
              |||||||||||||||||:|||||
orf128-1      YMGREFHKHERLLKSSHGGALQX
```

Homology with a Predicted ORF from *N. gonorrhoeae*
ORF128 shows 93.4% identity over 244 aa overlap with a predicted ORF (ORF128ng) from *N. gonorrhoeae*:

```
orf128.pep                               VSLASVIASQIFLYEDFNQMRKTVELSAVF    30
                                         ||||||||||||||||||||||||:|||:||
orf128ng      ILSEIQNGSFSFRDFYTRRIKRIYPAFIAAVSLASVIASQIFLYEDFNQMRKTIELSTVF   112
orf128.pep    LSNIYLGFQQGYFDLSADENPVLHIWSLAVEEQYYLLYPLLLIFCCKKTKSLRVLRNISI    90
              ||||||||:|||||||||||||||||||||||||||||||||||:|||||||||||||||
orf128ng      LSNIYLGFRLGYFDLSADENPVLHIWSLAVEEQYYLLYPLLLIFCYKKTKSLRVLRNISI   172
orf128.pep    ILFLILTASSFLPSGFYTDILNQPNTYYLSTLRFPELLAGSLLAVYGQTQNGRRQTANGK   150
              |||||||||:||||:|||||||||||||||||||||||||:|||||||||||||||:|||
orf128ng      ILFLILTASSFLPAGFYTDILNQPNTYYLSTLRFPELLVGSLLAVYGQTQNGRRQTENGK   232
orf128.pep    RQLLSSLCFGALLACLFVIDKHNPFIPGMTLLLPCLLTALLIRSMQYGTLPTRILSASPI   210
              |||||:|||||||:||||||||:||||:|||||||||||||||||||||||||||||||
orf128ng      RQLLSLLCFGALLVCLFVIDKHDPFIPGITLLLPCLLTALLIRSMQYGTLPTRILSASPI   292
```

The complete length ORF128ng nucleotide sequence
<SEQ ID 833> is:

```
   1 ATGCAAGCTG TCCGATACAG GCCTGAAATT GACGGATTGC GGGCCGTCGC
  51 CGTGCTATCC GTCATTATTT TCCACCTGAA TAACCGCTGG CTGCCCGGAG
 101 GATTCCTGGG GGTGGACATT TTCTTTGTCA TCTCGGGATT CCTCATTACC
 151 AACATCATTC TTTCTGAAAT ACAGAACGGT TCTTTTTCTT TCCGGGATTT
 201 TTATACCCGC AGGATTAAGC GGATTTATCC TGCTTTTATT GCGGCCGTGT
 251 CCCTGGCTTC GGTGATTGCT TCTCAAATCT TCCTTTACGA AGATTTCAAC
 301 CAAATGAGGA AAACCATAGA GCTTTCTACG GTTTTTTTGT CCAATATTTA
 351 TTTGGGGTTC CGATTGGGGT ATTTCGATTT GAGTGCCGAC GAGAACCCCG
 401 TACTGCATAT CTGGTCTTTG GCGGTAGAGG AACAGTATTA CCTCCTGTAT
 451 CCTCTTTTGC TGATATTCTG TTACAAAAAA ACCAAATCAC TACGGGTGCT
 501 GCGTAATATC AGCATCATCC TGTTTCTGAT TTTGACCGCA TCATCGTTTT
 551 TGCCGGCCGG GTTTTATACC GACATCCTCA ACCAACCcaa TACTTATTAC
 601 CTTTCGACAC TGAGGTTTCC CGAGCTGTTG GTGGGTTCGC TGTTGGCGGT
 651 TTACGGGCAA ACGCAAAACG GCAGACGGCA AACAGAAAAT GGAAAACGGC
 701 AGTTGCTTTC ATTACTCTGT TTCGGCGCat tgCTTGTCTG CCTGTTCGTG
 751 ATCGACAAAC ACGATCCGTT TATCCCGGGA ATAACCCTGC TCCTTCCCTG
 801 CCTGCTGACG GCGCTGCTTA TCCGGAGTAT GCAATACGGG ACACTTCCGA
 851 CCCGCATCCT GTCGGCAAGC CCATCGTAT TTGTCGGCAA AATCTCTTAT
 901 TCCCTATACC TGTACCATTG GATTTTTATT GCCTTCGCCC ATTACATTAC
 951 AGGCGACAAA CAGCTCGGAC TGCCTGCCGT ATCGGCGGTT GCCGCGTTGA
1001 CGGCCGGATT TTCCCTGTTG AGCTATTATT TGATTGAACA GCCGCTTAGA
1051 AAACGGAAGA TGACCTTCAA AAAGGCATTT TTCTGCCTTT ATCTCGCCCC
1101 GTCCCTGATG CTTGTCGGTT ACAACCTGTA TTCAAGAGGG ATATTGAAAC
1151 AGGAACACCT CCGCCCGCTG CCCGGCACGC CCGTTGCTGC GGAAAATAAT
1201 TTTCCGGAAA CCGTCTTGAC CCTCGGCGAC TCGCACGCCG GACACCTGCG
1251 GGGGTTTCTG GATTATGTCG GCGGCAGGGA AGGGTGGAAA GCTAAAATCC
1301 TGTCCCTCGA TTCGGAGTGT TTGGTTTGGG TGGATGAGAA GCTGGCAGAC
1351 AACCCGTTGT GCCGAAAATA CCGGGATGAA GTTGAAAAAG CCGAAGCTGT
1401 TTTCATTGCC CAATTCTATG ATTTGAGGAT GGGCGGCCAG CCCGTGCCGA
1451 GATTTGAAGC GCAATCCTTC CTGATACCCG GGTTCAAAGC CCGATTCAGG
1501 GAAACCGTCA AGAGGATAGC CGCCGTCAAA CCTGTATATG TTTTTGCAAA
1551 CAATACATCA ATCAGCCGTT CTCCCTTGAG GGAGGAAAAA TTGAAAAGAT
1601 TTGCTATAAA CCAATACCTC CGGCCTATTC GGGCTATGGG CGACATCGGC
1651 AAGAGCAATC AGGCGGTCTT TGATTTGGTT AAAGATATTC CCAATGTGCA
1701 TTGGGTGGAC GCACAAAAAT ACCTGCCCAA AAACACGGTC GAAATACACG
1751 GACGCTATCT TTACGGCGAC CAAGACCACC TGACCTATTT CGGTTCTTAT
1801 TATATGGGGC GGGAATTTCA CAAACACGAA CGCCTGCTCA AGCATTCCCG
1851 AGGCGGCGCA TTGCAGTAG
```

This encodes a protein having amino acid sequence <SEQ ID 834>:

```
  1 MQAVRYRPEI DGLRAVAVLS VIIFHLNNRW LPGGFLGVDI FFVISGFLIT

51 NIILSEIQNG SFSFRDFYTR RIKRIYPAFI AAVSLASVIA SQIFLYEDFN

101 QMRKTIELST VFLSNIYLGF RLGYFDLSAD ENPVLHIWSL AVEEQYYLLY

151 PLLLIFCYKK TKSLRVLRNI SIILFLILTA SSFLPAGFYT DILNQPNTYY

201 LSTLRFPELL VGSLLAVYGQ TQNGRRQTEN GKRQLLSLLC FGALLVCLFV

251 IDKHDPFIPG ITLLLPCLLT ALLIRSMQYG TLPTRILSAS PIVFVGKISY

301 SLYLYHWIFI AFAHYITGDK QLGLPAVSAV AALTAGFSLL SYYLIEQPLR

351 KRKMTFKKAF FCLYLAPSLM LVGYNLYSRG ILKQEHLRPL PGTPVAAENN

401 FPETVLTLGD SHAGHLRGFL DYVGGREGWK AKILSLDSEC LVWVDEKLAD

451 NPLCRKYRDE VEKAEAVFIA QFYDLRMGGQ PVPRFEAQSF LIPGFKARFR

501 ETVKRIAAVK PVYVFANNTS ISRSPLREEK LKRFAINQYL RPIRAMGDIG

551 KSNQAVFDLV KDIPNVHWVD AQKYLPKNTV EIHGRYLYGD QDHLTYFGSY

601 YMGREFHKHE RLLKHSRGGA LQ*
```

ORF128ng and ORF128-1 show 95.7% identity in 622 aa overlap:

```
orf128-1.pep  MQAVRYRPEIDGLRAVAVLSVMIFHLNNRWLPGGFLGVDIFFVISGFLITGIILSEIQNG
              ||||||||||||||||||||| :|||||||||||||||||||||||||||  :|||||||
orf128ng      MQAVRYRPEIDGLRAVAVLSVIIFHLNNRWLPGGFLGVDIFFVISGFLITNIILSEIQNG orf128-1.pep  SFSFRDFYTRRIKRIYPAFIAAVSLASVIASQIFLYEDFNQMRKTVELSAVFLSNIYLGF
              |||||||||||||||||||||||||||||||||||||||||||||| :|| ||||||||
orf128ng      SFSFRDFYTRRIKRIYPAFIAAVSLASVIASQIFLYEDFNQMRKTIELSTVFLSNIYLGF orf128-1.pep  QQGYFDLSADENPVLHIWSLAVEEQYYLLYPLLLIFCCKKTKSLRVLRNISIILFLILTA
              : ||||||||||||||||||||||||||||||||||| |||||||||||||||||||||
orf128ng      RLGYFDLSADENPVLHIWSLAVEEQYYLLYPLLLIFCYKKTKSLRVLRNISIILFLILTA orf128-1.pep  SSFLPSGFYTDILNQPNTYYLSTLRFPELLAGSLLAVYGQTQNGRRQTANGKRQLLSSLC
              ||||| :||||||||||||||||||||||||  ||||||||||||||| |||||||| |
orf128ng      SSFLPAGFYTDILNQPNTYYLSTLRFPELLVGSLLAVYGQTQNGRRQTENGKRQLLSLLC orf128-1.pep  FGALLACLFVIDKHNPFIPGMTLLLPCLLTALLIRSMQYGTLPTRILSASPIVFVGKISY
              |||||.|||||||:||||||:||||||||:||||||||||||||||||||||||||||
orf128ng      FGALLVCLFVIDKHDPFIPGITLLLPCLLTALLIRSMQYGTLPTRILSASPIVFVGKISY orf128-1.pep  SLYLYHWIFIAFAHYITGDKQLGLPAVSAVAALTAGFSLLSYYLIEQPLRKRKMTFKKAF
              ||||||||||||||||||||||||||||||||||||||||||||||||||||||||||||
orf128ng      SLYLYHWIFIAFAHYITGDKQLGLPAVSAVAALTAGFSLLSYYLIEQPLRKRKMTFKKAF orf128-1.pep  FCLYLAPSLILVGYNLYARGILKQEHLRPLPGAPLAAENHFPETVLTLGDSHAGHLRGFL
              |||||||||:||||||||:|||||||||||| :|: |||||||||||||||||||||||
orf128ng      FCLYLAPSLMLVGYNLYSRGILKQEHLRPLPGTPVAAENNFPETVLTLGDSHAGHLRGFL orf128-1.pep  DYVGSREGWKAKILSLDSECLVWVDEKLADNPLCRKYRDEVEKAEAVFIAQFYDLRMGGQ
              ||||.|||||||||||||||||||||||||||||||||||||||||||||||||||||||
orf128ng      DYVGGREGWKAKILSLDSECLVWVDEKLADNPLCRKYRDEVEKAEAVFIAQFYDLRMGGQ orf128-1.pep  PVPRFEAQSFLIPGFPARFRETVKRIAAVKPVYVFANNTSISRSPLREEKLKRFAANQYL
              |||||||||||||||.||||||||||||||||||||||||||||||||||||||| ||||
orf128ng      PVPRFEAQSFLIPGFKARFRETVKRIAAVKPVYVFANNTSISRSPLREEKLKRFAINQYL orf128-1.pep  RPIQAMGDIGKSNQAVFDLIKDIPNVHWVDAQKYLPKNTVEIYGRYLYGDQDHLTYFGSY
              |||:|||||||||||||||:|||||||||||||||||||||| |||||||||||||||||
orf128ng      RPIRAMGDIGKSNQAVFDLVKDIPNVHWVDAQKYLPKNTVEIHGRYLYGDQDHLTYFGSY orf128-1.pep  YMGREFHKHERLLKSSHGGALQX
              |||||||||||||| :|||||||
orf128ng      YMGREFHKHERLLKHSRGGALQX
```

In addition, ORF218ng shows homology to a hypothetical
*H. influenzae* protein:

```
sp|P43993|Y392_HAFIN HYPOTHETICAL PROTEIN HI0392 >gi|1074385|pir|B64007
hypothetical protein HI0392 - Haemophilus influenzae (strain Rd KW20)
>gi|1573364 (U32723) H. influenzae predicted coding region HI0392
[Haemophilus influenzae] Length = 245
Score = 239 bits (604), Expect = 3e-62
Identities = 124/225 (55%), Positives = 152/225 (67%), Gaps = 1/225 (0%)

Query:  38 VDIFFVISGFLITNIILSEIQNGSFSFRDFYTRRIKRIYPXXXXXXXXXXXXXXXXXFLYE   97
            +DIFFVISGFLIT II++EIQ  SFS + FYTRRIKRIYP              F+Y
Sbjct:   1 MDIFFVISGFLITGIIITEIQQNSFSLKQFYTRRIKRIYPAFITVMALVSFIASAIFIYN   60

Query:  98 DFNQMRKTIELSTVFLSNIYLGFRLGYFDLSADENPVLHIWSLAVEEQXXXXXXXXXXIFC  157
            DFN++RKTIEL+  FLSN YLG   GYFDLSA+ENPVLHIWSLAVE Q          I
Sbjct:  61 DFNKLRITIELAIAFLSNFYLGLTQGYFDLSANENPVLHIWSLAVEGQYYLIFPLILILA  120

Query: 158 YKKTKSLRVLRNISIILFLILTASSFLPAGFYTDILNQPNTYYLSTLRFPELLVGSLLAV  217
            YKK + ++VL  I++ILF IL A+SF+ A FY ++L+QPN YYLS LRFPELLVGSLLA+
Sbjct: 121 YKKFREVKVLFIITLILFFILLATSFVSANFYKEVLHQPNIYYLSNLRFPELLVGSLLAI  180

Query: 218 YGQTQNGRRQTENGKRQLLSLLCFGALLVCLFVIDKHDPFIPGIT                 262
            Y  N + Q        +L++L   L  CLF+++ +  FIPGIT
Sbjct: 181 YHNLSN-KVQLSKQVNNILAILSTLLLFSCLFLMNNNIAFIPGIT                 224
```

This analysis, including the identification of several putative transmembrane domains, suggests that these proteins from *N. meningitidis* and *N. gonorrhoeae*, and their epitopes, could be useful antigens for vaccines or diagnostics, or for raising antibodies.

Example 99

The following partial DNA sequence was identified in *N. meningitidis* <SEQ ID 835>:

```
  1 ..ATTATTTACG AATACCGCTG GATGTTTCTT TACGGCGCAC TGACGACCTT

51   GGGGCTGACG GTCGTGGCAA C.GCGGGCGG TTCGGTATTG GGTCTGTTGT

101   TGGCGTTGGC GCGCCTGATT CACTTGGAAA AAGCCGGTGC GCCGATGCGC

151   GTGCTGGCGT GGGCGTTGCG TAAAGTTTCG CTGCTGTATG TTACGCTGTT

201   CCGGGGTACG CCGCTGTTTG TGCAGATTGT GATTTGGGCG TATGTGTGGT

251   TTCCGTTTTT CGTC..
```

This corresponds to the amino acid sequence <SEQ ID 836; ORF129>:

```
  1 ..IIYEYRWMFL YGALTTLGLT VVAXAGGSVL GLLLALARLI HLEKAGAPMR

51   VLAWALRKVS LLYVTLFRGT PLFVQIVIWA YVWFPFFV..
```

Further work revealed the complete nucleotide sequence <SEQ ID 837>:

```
  1 ATGGATTTTC GTTTTGACAT TATTTACGAA TACCGCTGGA TGTTTCTTTA

51 CGGCGCACTG ACGACCTTGG GGCTGACGGT CGTGGCAACG GCGGGCGGTT

101 CGGTATTGGG TCTGTTGTTG GCGTTGGCGC GCCTGATTCA CTTGGAAAAA

151 GCCGGTGCGC CGATGCGCGT GCTGGCGTGG GCGTTGCGTA AAGTTTCGCT
```

```
201 GCTGTATGTT ACGCTGTTCC GGGGTACGCC GCTGTTTGTG CAGATTGTGA

251 TTTGGGCGTA TGTGTGGTTT CCGTTTTTCG TCCATCCTTC AGACGGCATT

301 TTGGTCAGCG GCGAGGCGGC AATCGCGCTG CGTCGCGGAT ACGGGCCGCT

351 GATTGCCGGT TCTTTGGCAC TGATCGCCAA CTCGGGGCG TATATCTGTG

401 AGATTTTCCG CGCGGGCATC CAGTCTATAG ACAAAGGACA GATGGAGGCG

451 GCGCGTTCTT TGGGGCTGAC CTATCCGCAG GCGATGCGCT ATGTGATTCT

501 GCCGCAGGCA TTGCGCCGCA TGCTGCCGCC TTTGGCGAGC GAGTTCATCA

551 CGCTCTTGAA AGACAGCTCG CTGCTGTCGG TCATTGCTGT GGCGGAGTTG

601 GCGTATGTTC AGAATACGAT TACGGGCCGG TATTCGGTTT ATGAAGAACC

651 GCTTTACACC GTCGCCCTGA TTTATCTGTT GATGACGACT TTCTTAGGCT

701 GGATATTCCT GCGTTTGGAA AAACGTTACA ATCCGCAACA CCGCTGA
```

This corresponds to the amino acid sequence <SEQ ID 838; ORF129-1>:

```
  1 MDFRFDIIYE YRWMFLYGAL TTLGLTVVAT AGGSVLGLLL ALARLIHLEK

51 AGAPMRVLAW ALRKVSLLYV TLFRGTPLFV QIVIWAYVWF PFFVHFSDGI

101 LVSGEAAIAL RRGYGPLIAG SLALIANSGA YICEIFRAGI QSIDKGQMEA

151 ARSLGLTYPQ AMRYVILPQA LRRMLPPLAS EFITLLKDSS LLSVIAVAEL

201 AYVQNTITGR YSVYEEPLYT VALIYLLMTT FLGWIFLRLE KRYNPQHR*
```

Computer analysis of this amino acid sequence gave the following results:

Homology with a Predicted ORF from *N. meningitidis* (Strain A)

ORF129 shows 98.9% identity over a 88aa overlap with an ORF (ORF129a) from strain A of *N. meningitidis*:

```
                   10        20        30        40        50
orf129.pep   IIYEYRWMFLYGALTTLGLTVVAXAGGSVLGLLLALARLIHLEKAGAPMRVLAW
             |||||||||||||||||||||| |||||||||||||||||||||||||||||||
orf129a   MDFRFDIIYEYRWMFLYGALTTLGLTVVATAGGSVLGLLLALARLIHLEKAGAPMRVLAW
                 10        20        30        40        50        60
                   60        70        80
orf129.pep   ALRKVSLLYVTLFRGTPLFVQIVIWAYVWFPFFV
             |||||||||||||||||||||||||||||||||
orf129a   ALRKVSLLYVTLFRGTPLFVQIVIWAYVWFPFFVHPSDGILVSGEAAIALRRGYGPLIAG
                 70        80        90       100       110       120
orf129a   SLALIANSGAYICEIFRAGIQSIDKGQMEAARSLGLTYPQAMRYVILPQALRRMLPPLAS
                130       140       150       160       170       180
```

The complete length ORF129a nucleotide sequence <SEQ ID 839> is:

```
  1 ATGGATTTTC GTTTTGACAT TATTTACGAA TACCGCTGGA TGTTTCTTTA

51 CGGCGCACTG ACGACCTTGG GGCTGACGGT CGTGGCGACG GCGGGCGGTT

101 CGGTATTGGG TCTGTTGTTG GCGTTGGCGC GCCTGATTCA CTTGGAAAAA
```

```
151 GCCGGTGCGC CGATGCGCGT GCTGGCGTGG GCGTTGCGTA AGGTTTCGCT

201 GCTGTATGTT ACGCTGTTCC GGGGTACGCC GCTGTTTGTG CAGATTGTGA

251 TTTGGGCGTA TGTGTGGTTT CCGTTTTTCG TCCATCCTTC AGACGGCATT

301 TTGGTTAGCG GCGAGGCGGC AATCGCGCTG CGTCGCGGAT ACGGGCCGCT

351 GATTGCCGGT TCTTTGGCAC TGATCGCCAA CTCGGGGCG TATATCTGTG

401 AGATTTTCCG CGCGGGCATC CAGTCTATAG ACAAAGGACA GATGGAGGCG

451 GCGCGTTCTT TGGGGCTGAC CTATCCGCAG GCGATGCGCT ATGTGATTCT

501 GCCGCAGGCA TTGCGCCGTA TGCTGCCGCC TTTGGCGAGC GAGTTCATCA

551 CGCTCTTGAA AGACAGCTCG CTGCTGTCGG TCATTGCTGT GGCGGAGTTG

601 GCGTATGTTC AGAATACGAT TACGGGCCGG TATTCGGTTT ATGAAGAACC

651 GCTTTACACC GTCGCCCTGA TTTATCTGTT GATGACGACT TTCTTAGGCT

701 GGATATTCCT GCGTTTGGAA AAACGTTACA ATCCGCAACA CCGCTGA
```

This encodes a protein having amino acid sequence <SEQ ID 840>:

```
  1 MDFRFDIIYE YRWMFLYGAL TTLGLTVVAT AGGSVLGLLL ALARLIHLEK

51 AGAPMRVLAW ALRKVSLLYV TLFRGTPLFV QIVIWAYVWF PFFVHPSDGI

101 LVSGEAAIAL RRGYGPLIAG SLALIANSGA YICEIFRAGI QSIDKGQMEA

151 ARSLGLTYPQ AMRYVILPQA LRRMLPPLAS EFITLLKDSS LLSVIAVAEL

201 AYVQNTITGR YSVYEEPLYT VALIYLLMTT FLGWIFLRLE KRYNFQHR*
```

ORF129a and ORF129-1 show 100.0% identity in 248 aa overlap:

```
orf129a.pep    MDFRFDIIYEYRWMFLYGALTTLGLTVVATAGGSVLGLLLALARLIHLEKAGAPMRVLAW
               ||||||||||||||||||||||||||||||||||||||||||||||||||||||||||||
orf129-1       MDFRFDIIYEYRWMFLYGALTTLGLTVVATAGGSVLGLLLALARLIHLEKAGAPMRVLAW orf129a.pep    ALRKVSLLYVTLFRGTPLFVQIVIWAYVWPPFFVHPSDGILVSGEAAIALRRGYGPLIAG
               ||||||||||||||||||||||||||||||||||||||||||||||||||||||||||||
orf129-1       ALRKVSLLYVTLFRGTPLFVQIVIWAYVWPPFFVHPSDGILVSGEAAIALRRGYGPLIAG orf129a.pep    SLALIANSGAYICEIFRAGIQSIDKGQMEAARSLGLTYPQAMRYVILPQALRRMLPPLAS
               ||||||||||||||||||||||||||||||||||||||||||||||||||||||||||||
orf129-1       SLALIANSGAYICEIFRAGIQSIDKGQMEAARSLGLTYPQAMRYVILPQALRRMLPPLAS orf129a.pep    EFITLLKDSSLLSVIAVAELAYVQNTITGRYSVYEEPLYTVALIYLIMTTFLGWIFLRLE
               ||||||||||||||||||||||||||||||||||||||||||||||||||||||||||||
orf129-1       EFITLLKDSSLLSVIAVAELAYVQNTITGRYSVYEEPLYTVALIYLIMTTFLGWIFLRLE orf129a.pep    KRYNPQHRX
               |||||||||
orf129-1       KRYNPQHRX
```

Homology with a Predicted ORF from *N. gonorrhoeae*

ORF129 shows 98.9% identity over a 88 aa overlap with a predicted ORF (ORF129ng) from *N. gonorrhoeae*:

```
orf129.pep        IIYEYRWMFLYGALTTLGLTVVAXAGGSVLGLLLALARLIHLEKAGAPQRVLAW    54
                  ||||||||||||||||||||||| ||||||||||||||||||||||||||||||
orf129ng   MDFRFDIIYEYRWMFLYGALTTLGLTVVATAGGSVLGLLLALARLIHLEKAGAPQRVLAW    60
```

```
                                  -continued
orf129.pep   ALRKVSLLYVTLFRGTPLFVQIVIWAYVWFPFFV                               88
             |||||||||||||||||||||||||||||||||
orf129ng     ALRKVSLLYVTLFRGTPLFVQIVIWAYVWFPFFVILHTAFLGNAMRQSRRVPDKGRWIAG    120
```

An ORF129ng nucleotide sequence <SEQ ID 841> was predicted to encode a protein having amino acid sequence <SEQ ID 842>:

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVIWAYVWF PFFVILHTAF

101  LGNAMRQSRR VPDKGRWIAG SLELNCQPRG RKTRGEFPPG ESNLGTEPRN

151  PLSMGQRRFP GCENWYPPQN FIKK*
```

Further work revealed the following gonococcal sequence <SEQ ID 843>:

```
  1  ATGGATTTTC gtTTTGACAT TATTTAcgaA TACCGCTGGA TGTTTCTTTA

51  CGGCGCACTG Acgaccttgg ggctgacggt cgtggcgacg gCGGGCGGTT

101  CGGtattggG TCTGTTGTTG GCGTTGGCGC GCCTGATTCA CTTGGAAAAA

151  GCCGGTGCGC CGATGCGCGT GCTGGCGTGG GCGTTGCGTA AGGTTTCGCT

201  GCTGTACGTT ACCCTGTTCC GGGGTACGCC GCTGTTTGTG CAGATTGTGA

251  TTTGGGCGTA TGTGTGGTTT CCGTTTTTCG TCCATCCTTC AGACGGCATT

301  TTGGTCAGCG GCGAGGCGGC AATCGCGCTG CGTCGCGGAT ACGGGCCGCT

351  GATTGCCGGT TCTTTGGCAC TGATCGCCAA CTCGGGGGCG TATATCTGTG

401  AGATTTTCCG CGCGGGCATC CAGTCTATAG ACAAAGGACA GATGGAGGCG

451  GCGTGTTCTT TGGGACTGAC CTATCCGCAG GCGATGCGCT ATGTGATTCT

501  GCCGCAGGCA TTGCGCCGTA TGCTGCCGCC TTTGGCGAGC GAGTTCATCA

551  CGCTCTTGAA AGACAGCTCG CTGCTGTCGG TCATTGCTGT GGCGGAGTTG

601  GCGTATGTTC AGAATACGAT TACGGGCCGG TATTCGGTTT ATGAAGAACC

651  GCTTTACACC GCCGCCCTGA TTTATCTGTT GATGACGACT TTCTTAGGCT

701  GGATATTCCT GCGTTTGGAA AAACGTTACA ATCCGCAACA CCGCTGA
```

This corresponds to the amino acid sequence <SEQ ID 844; ORF129ng-1>:

```
  1  MDFRFDIIYE YRWMFLYGAL TTLGLTVVAT AGGSVLGLLL ALARLIHLEK

51  AGAPMRVLAW ALRKVSLLYV TLFRGTPLFV QIVIWAYVWF PFFVHPSDGI

101  LVSGEAAIAL RRGYGPLIAG SLALIANSGA YICEIFRAGI QSIDKGQMEA

151  ARSLGLTYPQ AMRYVILPQA LRRMLPPLAS EFITLLKDSS LLSVIAVAEL

201  AYVQNTITGR YSVYEEPLYT VALIYLLMTT FLGWIFLRLE KRYNPQHR*
```

ORF129ng-1 and ORF129-1 show 99.2% identity in 248 aa overlap:

```
orf129-1.pep   MDFRFDIIYEYRWMFLYGALTTLGLTVVATAGGSVLGLLLALARLIHLEKAGAPMRVLAW
               ||||||||||||||||||||||||||||||||||||||||||||||||||||||||||||
orf129ng-1     MDFRFDIIYEYRWMFLYGALTTLGLTVVATAGGSVLGLLLALARLIHLEKAGAPMRVLAW orf129-1.pep   ALRKVSLLYVTLFRGTPLFVQIVIWAYVWFPFFVHPSDGILVSGEAAIALRRGYGPLIAG
               ||||||||||||||||||||||||||||||||||||||||||||||||||||||||||||
orf129ng-1     ALRKVSLLYVTLFRGTPLFVQIVIWAYVWFPFFVHPSDGILVSGEAAIALRRGYGPLIAG orf129-1.pep   SLALIANSGAYICEIFRAGIQSIDKGQMEAARSLGLTYPQAMRYVILPQALRRMLPPLAS
               ||||||||||||||||||||||||||||||||||||||||||||||||||||||||||||
orf129ng-1     SLALIANSGAYICEIFRAGIQSIDKGQMEAARSLGLTYPQAMRYVILPQALRRMLPPLAS orf129-1.pep   EFITLLKDSSLLSVIAVAELAYVQNTITGRYSVYEEPLYTVALIYLIMTTFLGWIFLRLE
               |||||||||||||||||||||||||||||||||||||||||:||||||||||||||||||
orf129ng-1     EFITLLKDSSLLSVIAVAELAYVQNTITGRYSVYEEPLYTAALIYLIMTTFLGWIFLRLE orf129-1.pep   KRYNPQHRX
               |||||||||
orf129ng-1     KRYNPQHRX
```

In addition, ORF129ng-1 is homologous to an ABC transporter from *A. fulgidus*:

```
2650409 (AE001090) glutamine ABC transporter, permease protein (glnP)
[Archaeoglobus fulgidus] Length = 224
Score = 132 bits (329), Expect = 2e-30
Identities = 86/176 (48%), Positives = 103/178 (57%), Gaps = 18/178 (10%)

Query:  65 VSLLYVTLFRGTPLFVQIVIWAYVWFPFFVHPSDGILVSGEAAIALRRGYGPLIAGSLAL  124
            +S  YV + RGTPL VQI+I      +F  P+ GI +  E A            G +AL
Sbjct:  58 ISTAYVEVIRGTPLLVQILI------VYFGLPAIGINLQPEPA-----------GIIAL   99

Query: 125 IANSGAYICEIFRAGIQSIDKGQMEAACSLGLTYPQAMRYVILPQALRRMLPPLASEFIT  184
            + SGAYI EI RAGI+SI  GQMEAA SLG+TY QAMRYVI PQA R +LP L +EFI
Sbjct: 100 SICSGAYIAEIVRAGIESIPIGQMEAARSLGMTYLQAMRYVIFPQAFRNILPALGNEFIA  159

Query: 185 LLKDSSLLSVIAVAELAYVQNTITGRYSVYEEPLYTAALIYLLMTTFLGWIFLRLEKR   242
            LLKDSSLLSVI++ EL  V   I        P    AL YL+MT  L  +    +K+
Sbjct: 160 LLKDSSLLSVISIVELTRVGRQIVNTTFNAWTPFLGVALFYLMMTIPLSRLVAYSQKK   217
```

This analysis, including the identification of transmembrane domains in the two proteins, suggests that the proteins from *N. meningitidis* and *N. gonorrhoeae*, and their epitopes, could be useful antigens for vaccines or diagnostics, or for raising antibodies.

Example 100

The following partial DNA sequence was identified in *N. meningitidis* <SEQ ID 845>:

```
  1..CTGAAAGAAT GCCGTCTGAA AGACCCTGTT TTTATTCCAA ATATCGTTTA

51  TAAGAACATC GCCATTACTT TCCTGCTCTT GCACGCCGCC GCCGAACTTT

101  GGCTGCCCGC GCAAACCGCC GGTTTTACCG CGCTCGCCGT CGGCTTCATC

151  CTGCTCGCCA AGCTGCGTGA gCTTCACCAT CACGAACTCT TACGTAAACA 201  cTACGTCCGC ACTTATTACy TGCTCCAACT CTTTGCCGCC GCAGgcTAgT

251  TTGTGGACAG GCGCGGCGwA ATTACAAAAC CTGCCCGCyT CCGCGCCCCT

301  GCACCTGATT ACCCTCGGCG GCATGATGGG CGGCGTGATG ATGGTGTGGc

351  TGACCGCCGG ACTGTGGCAC AGCGGCTTTA CCAAACTCGA CTACCCCAAA

401  CTCTGCCGCA TTGCCGTCCC CATCCTTTTC GCCGCCGCCG TCTCGCGCGC
```

-continued

```
451  TTTCTTGrTG AACGTGAACC CGrTATTTTT CATTACCGTT CCTGCGATTC

501  TGACCGCCGC CGTATTCGTA CTGTATCTTT TCrCGTTTAT ACCGATATTT

551  CGGGCGAATG CGTTTACAGA CGATCCGGAr TAr
```

This corresponds to the amino acid sequence <SEQ ID 846; ORF130>:

```
  1..LKECRLKDPV FIPNIVYKNI AITFLLLHAA AELWLPAQTA GFTALAVGFI

51  LLAKLRELHH HELLRKHYVR TYYLLQLFAA AGSLWTGAAX LQNLPASAPL

101  HLITLGGMMG GVMMVWLTAG LWHSGFTKLD YPKLCRIAVP ILFAAAVSRA

151  FLXNVNPXFF ITVPAILTAA VFVLYLFXFI PIFRANAFTD DPE*
```

Further work revealed the complete nucleotide sequence <SEQ ID 847>:

```
   1 ATGCGGCCGT TTTTCGTCGG CGCGGCGGTG CTTGCCATAC TCGGTGCGCT

51 GGTGTTTTTC ATCAACCCCG GTGCCATCGT CCTGCACCGC CAAATTTTCT

101 TGGAACTTAT GCTGCCGGCG GCATACGGCG GTTTTTTGAC TGCGGCTTTG

151 TTGGACTGGA CGGGTTTTTC GGGTAACCTG AAACCTGTCG CGACTTTGAT

201 GGCGGCATTA TTGCTCGCCG CATCCGCTAT ACTGCCCTTT TCGCCGCAAA

251 CTGCCTCGTT TTTCGTCGCC GCCTATTGGC TGGTGTTGCT GCTGTTCTGC

301 GCCCGGCTGA TTTGGCTAGA CCGAAACACC GACAACTTCG CCCTGCTAAT

351 GTTACTTGCC GCGTTCACTG TTTTTCAGAC GGCATATGCC GTCAGCGGCG

401 ATTTGAACCT GTTGCGCGCG CAAGTGCATC TAAATATGGC GGCGGTGATG

451 TTCGTATCCG TGCGCGTCAG TATTCTTTTG GGCGCGGAAG CCCTGAAAGA

501 ATGCCGTCTG AAAGACCCTG TTTTTATTCC AAATATCGTT TATAAAAACA

551 TCGCCATTAC TTTCCTGCTC TTGCACGCCG CCGCCGAACT TTGGCTGCCC

601 GCGCAAACCG CCGGTTTTAC CGCGCTCGCC GTCGGCTTCA TCCTGCTCGC

651 CAAGCTGCGT GAGCTTCACC ATCACGAACT CTTACGTAAA CACTACGTCC

701 GCACTTATTA CCTGCTCCAA CTCTTTGCCG CCGCAGGCTA TTTGTGGACA

751 GGCGCGGCGA AATTACAAAA CCTGCCCGCC TCCGCGCCCC TGCACCTGAT

801 TACCCTCGGC GGCATGATGG GCGGCGTGAT GATGGTGTGG CTGACCGCCG

851 GACTGTGGCA CAGCGGCTTT ACCAAACTCG ACTACCCCAA ACTCTGCCGC

901 ATTGCCGTCC CCATCCTTTT CGCCGCCGCC GTCTCGCGCG CTTTCTTGAT

951 GAACGTGAAC CCGATATTTT TCATTACCGT TCCTGCGATT CTGACCGCCG

1001 CCGTATTCGT ACTGTATCTT TTCACGTTTA TACCGATATT TCGGGCGAAT

1051 GCGTTTACAG ACGATCCGGA ATAA
```

This corresponds to the amino acid sequence <SEQ ID 848; ORF130-1>:

```
  1 MRPFFVGAAV LAILGALVFF INPGAIVLHR QIFLELMLPA AYGGFLTAAL
 51 LDWTGESGNL KPVATLMAAL LLAASAILPF SPQTASFFVA AYWLVLLLFC
101 ARLIWLDRNT DNFALLMLLA AFTVFQTAYA VSGDLNLLRA QVHLNMAAVM
151 FVSVRVSILL GAEALKECRL KDPVFIPNIV YKNIAITFLL LHAAAELWLP
201 AQTAGFTALAVGFILLAKLR ELHHHELLRK HYVRTYYLLQ LFAAAGYLWT
251 GAAKLQNLPA SAPLHLITLG GMMGGVMMVW LTAGLWHSGF TKLDYPKLCR
301 IAVPILFAAA VSRAFLMNVN PIFFITVPAI LTAAVFVLYL FTFIPIFRAN
351 AFTDDPE*
```

Computer analysis of this amino acid sequence gave the following results:

Homology with a Predicted ORF from *N. meningitidis* (Strain A)

ORF130 shows 94.3% identity over a 193aa overlap with an ORF (ORF130a) from strain A of *N. meningitidis*:

```
                                              10        20        30
orf130.pep                               LKECRLKDPVFIPNIVYKNIAITFLLLHAA
                                         ||||||||||||||||:|||||||||||||
orf130a    LNLLRAQVHLNMAAVMFVSVRVSILLGAEALKECRLKDPVFIPNVVYKNIAITFLLLHAA
               140       150       160       170       180       190
                    40        50        60        70        80        90
orf130.pep AELWLPAQTAGFTALAVGFILLAKLRELHHHELLRKHYVRTYYLLQLFAAAGSLWTGAAX
           ||||||||||||:|||||||||||||||||||||||||||||||||||||||:||||||
orf130a    AELWLPAQTAGFTSLAVGFILLAKLRELHHHELLRKHYVRTYYLLQLFAAAGYLWTGAAK
               200       210       220       230       240       250
                   100       110       120       130       140       150
orf130.pep LQNLPASAPLHLITLGGMMGGVMMVWLTAGLWHSGFTKLDYPKLCRIAVPILFAAAVSRA
           ||||||||||||||||||||||:|||||||||||||||||||||||||||||||||||||
orf130a    LQNLPASAPLHLITLGGMMGSVMMVWLTAGLWHSGFTKLDYPKLCRIAVPILFAAAVSRA
               260       270       280       290       300       310
                   160       170       180       190
orf130.pep FLXNVNPXFFITVPAILTAAVFVLYLFXFIPIFRANAFTDDPEX
           | |||| ||||||||||||||||||||::|||||||||||||||
orf130a    VLMNVNPIFFITVPAILTAAVFVLYLLTFVPIFRANAFTDDPEX
               320       330       340       350
```

The complete length ORF130a nucleotide sequence <SEQ ID 849> is:

```
  1 ATGCGGCCGT TTTTCGTCGG CGCGGCGGTC CTTGCCATAC TCGGTGCGCT
 51 GGTGTTTTTC ATCAACCCCG GTGCCATCGT CCTGCACCGC CAAATTTTCT
101 TGGAACTTAT GCTGCCGGCG GCATACGGCG GTTTTTTGAC TGCGGCTTTG
151 TTGGACTGGA CGGGTTTTTC GGGTAACCTG AAACCTGTCG CGACTTTGAT
201 GGCGGCATTA TTGCTCGCCG CATCCGCTAT ACTGCCCTTT TCGCCGCAAA
251 CTGCCTCGTT TTTCGTCGCC GCCTATTGGC TGGTGTTGCT GCTGTTCTGC
301 GCCCGGCTGA TTTGGCTAGA CCGAAACACC GACAACTTCG CCCTGCTAAT
351 GTTACTTGCC GCGTTCACTG TTTTTCAGAC GGCATATGCC GTCAGCGGCG
401 ATTTGAACCT GTTGCGCGCG CAAGTGCATC TAAATATGGC GGCGGTGATG
451 TTCGTATCCG TGCGCGTCAG TATTCTTTTG GGCGCGGAAG CCCTGAAAGA
```

-continued

```
 501 ATGCCGTCTG AAAGACCCAG TATTCATCCC CAATGTCGTC TATAAAAACA
 551 TCGCCATTAC CTTCCTGCTC CTGCACGCCG CCGCCGAACT TTGGCTGCCT
 601 GCGCAAACCG CCGGTTTTAC CTCGCTCGCC GTCGGCTTTA TCCTGCTTGC
 651 CAAGCTGCGT GAGCTTCACC ATCACGAACT CCTGCGCAAA CACTACGTCC
 701 GCACTTATTA CCTGCTCCAA CTCTTTGCCG CCGCAGGCTA TTTGTGGACA
 751 GGCGCGGCGA AATTACAAAA CCTGCCCGCC TCCGCGCCCC TGCACCTCAT
 801 TACCCTCGGT GGCATGATGG GCAGCGTGAT GATGGTGTGG CTGACTGCCG
 851 GACTGTGGCA CAGCGGCTTT ACCAAGCTCG ACTACCCGAA ACTCTGCCGC
 901 ATCGCCGTCC CCATCCTNTT CGCCGCCGCC GTTTCGCGCG CTGTTTTAAT
 951 GAACGTAAAC CCGATATTCT TCATCACCGT CCCCGCAATT CTGACCGCCG
1001 CCGTGTTCGT GCTTTACCTG CTGACATTCG TACCGATCTT TCGGGCGAAC
1051 GCGTTTACAG ACGATCCGGA ATAA
```

This encodes a protein having amino acid sequence <SEQ ID 850>:

```
  1 MRPFFVGAAV LAILGALVFF INPGAIVLHR QIFLELMLPA AYGGFLTAAL
 51 LDWTGFSGNL KPVATLMAAL LLAASAILPF SPQTASFFVA AYWLVLLLFC
101 ARLIWLDRNT DNFALLMLLA AFTVFQTAYA VSGDLNLLRA QVHLNMAAVM
151 FVSVRVSILL GAEALKECRL KDFVFIPNVV YKNIAITFLL LHAAAELWLP
201 AQTAGFTSLA VGFILLAKLR ELHHHELLRK HYVRTYYLLQ LFAAAGYLWT
251 GAAKLQNLPA SAPLHLITLG GMMGSVMMVW LTAGLWHSGF TKLDYPKLCR
301 IAVPILFAAA VSRAVLMNVN PIFFITVPAI LTAAVFVLYL LTFVPIFRAN
351 AFTDDPE*
```

ORF130a and ORF130-1 show 98.3% identity in 357 aa overlap:

```
orf130a.pep  MRPFFVGAAVLAILGALVFFINPGAIVLHRQIFLELMLPAAYGGFLTAALLDWTGFSGNL
             ||||||||||||||||||||||||||||||||||||||||||||||||||||||||||||
orf130-1     MRPFFVGAAVLAILGALVFFINPGAIVLHRQIFLELMLPAAYGGFLTAALLDWTGFSGNL orf130a.pep  KPVATLMAALLLAASAILPFSPQTASFFVAAYWLVLLLFCARLIWLDRNTDNFALLMLLA
             ||||||||||||||||||||||||||||||||||||||||||||||||||||||||||||
orf130-1     KPVATLMAALLLAASAILPFSPQTASFFVAAYWLVLLLFCARLIWLDRNTDNFALLMLLA orf130a.pep  AFTVFQTAYAVSGDLNLLRAQVHLNMAAVMFVSVRVSILLGAEALKECRLKDPVFIPNVV
             |||||||||||||||||||||||||||||||||||||||||||||||||||||||||:|
orf130-1     AFTVFQTAYAVSGDLNLLRAQVHLNMAAVMFVSVRVSILLGAEALKECRLKDPVFIPNIV orf130a.pep  YKNIAITFLLHAAAELWLPAQTAGFTSLAVGFILLAKLRELHHHELLRKHYVRTYYLLQ
             |||||||||||||||||||||||||:|||||||||||||||||||||||||||||||||
orf130-1     YKNIAITFLLHAAAELWLPAQTAGFTALAVGFILLAKLRELHHHELLRKHYVRTYYLLQ orf130a.pep  LFAAAGYLWTGAAKLQNLPASAPLGLITLGGMMGSVMMVWLTAGLWHSGFTKLDYPKLCR
             |||||||||||||||||||||||||||||||:||||||||||||||||||||||||||||
orf130-1     LFAAAGYLWTGAAKLQNLPASAPLGLITLGGMMGVMMVWLTAGLWHSGFTKLDYPKLCR orf130a.pep  IAVPILFAAAVSRAVLMNVNPIFFITVPAILTAAVFVLYLLTFVPIFRANAFTDDPE
             ||||||||||||||:|||||||||||||||||||||||:|||||||||||||||||
orf130-1     IAVPILFAAAVSRAFLMNVNPIFFITVPAILTAAVFVLYLFTFIPIFRANAFTDDPE
```

Homology with a Predicted ORF from *N. gonorrhoeae*

ORF130 shows 91.7% identity over a 193 aa overlap with a predicted ORF (ORF130ng) from *N. gonorrhoeae*:

```
orf130.pep                               LKECRLKDPVFIPNIVYKNIAITFLLLHAA    30
                                         |||||||||||||||||::||||||| ||||||
orf130ng   LNLLRAQVHLNMAAVMFVSVRVSILLGAEALKECRLKDPVFIPNVIYKNIAIT-LLLHAA   201
orf130.pep AELWLPAQTAGFTALAVGFILLAKLRELHHHELLRKHYVRTYYLLQLFAAAGSLWTGAAX     90
           |||||||||||||||||||||||||||||||||||||||||||||||||| |||||||||
orf130ng   AELWLPAQTAGFTALAVGFILLAKLRELHHHELLRKHYVRTYYLLQLFAAAGYLWTGAAK   261
orf130.pep LQNLPASAPLHLITLGGMMGGVMMVWLTAGLWHSGFTKLDYPKLCRIAVPILFAAAVSRA   150
           |||||||||||||||||| |||||||||||||||||||||||||||||||:||||||||
orf130ng   LQNLPASAPLHLITLGGMTGGVMMVWLTAGLWHSGFTKLDYPKLCRIAVSILFASAVSRA   321
orf130.pep FLXNVNPXFFITVPAILTAAVFVLYLFXIPIFRANAFTDDPEX                   193
           ||||||||:||||||||:|||:|:||||||||||||||||||
orf130ng   VLMNVNPIFFITVPEILTAAVFMLYLLTFVPIFRANAFTDDPEX                  364
```

An ORF130ng nucleotide sequence <SEQ ID 851> was predicted to encode a protein having amino acid sequence <SEQ ID 852>:

```
  1 MNKFFTHPMR PFFVGAAVLA ILGALVFFHQ PRRYHPAPPN FLGTYAAGCI
 51 RRFFDYRFVG PDGFFRQPET CRYFDGGVVA CCGCFIAVFT ATCRIFRRRL
101 LAGVAAVLRL ADLARRQHRT LRSVDVTAAF TVFQTAYAVS GDLNLLRAQV
151 HLNMAAVMFV SVRVSVLLGT ETLKECRLKD PVFIPNVIYK NIAITLLLHA
201 AAELWLPAQT AGFTALAVGF ILLAKLRELE HHELLRKHYV RTYYLLQLFA
251 AAGYLWTGAA KLQNLPASAP LHLITLGGMT GGVMMVWLTA GLWHSGFTKL
301 DYPKLCRIAV SILFASAVSR AVLMNVNPIF FITVPEILTA AVFMLYLLTF
351 VPIFRANAFT DDPE*
```

Further work revealed the following gonococcal DNA sequence <SEQ ID 853>:

```
  1 ATGCGCCCGT TTTTCGTCGG TGCGGCAGTA CTTGCCATAC TCGGTGCGTT
 51 GGTGTTTTTT ATCAACCCCG GCGCTATCAT CCTGCACCGC CAAATTTTCT
101 TGGAACTTAT GCTGCCGGCT GCATACGGCG GTTTTTTGAC TACCGCTTTG
151 TTGGACCGGA CGGGTTTTTC AGGCAACCTG AAACCTGCCG CTACTTTGAT
201 GGCGGTGTTG TTGCTTGTTG CGGCTGTTTT ATTGCCGTTT TTACCGCAAC
251 TTGCCGCATT TTTCGTCGCC GCCTATTGGC TGGTGTTGCT GCTGTTCTGC
301 GCCTGGCTGA TTTGGCTCGA CCGCAACACC GACAACTTCG CTCTGTTGAT
351 GTTACTTGCC GCATTTACCG TTTTTCAGAC GGCCTATGCC GTCAGCGGCG
401 ATTTGAACTT ACTGCGCGCG CAAGTGCATT TGAATATGGC GGCGGTCATG
451 TTCGTATCCG TCCGCGTCAG CGTCCTTTTG GCACGGAAA CCCTGAAAGA
501 ATGCCGTCTG AAAGACCCCG TATTCATCCC AACGTTATC TATAAAAACA
551 TCGCCATCAC CCTGCTGCTG CACGCCGCCG CCGAACTTTG GCTGCCCGCG
601 CAAACCGCCG GTTTTACTGC GCTTGCCGTC GGCTTCATCC TGCTCGCCAA
651 GCTGCGCGAA CTGCACCATC ACGAACTCTT ACGCAAACAC TACGTCCGCA
701 CTTATTACCT GCTCCAGCTC TTTGCCGCCG CAGGTTATCT GTGGACAGGC
751 GCGGCGAAAC TGCAAAACCT GCCCGCCTCC GCGCCCCTGC ACCTGATTAC
801 CCTCGGCGGC ATGACGGGTG GCGTGATGAT GGTGTGGCTG ACTGCCGGAC
```

```
    -continued
 851 TGTGGCACAG CGGCTTTACC AAACTCGACT ACCCGAAACT CTGCCGCATC

901 GCCGTCTCCA TCCTTTTCGC CTCCGCCGTT TCGCGCGCTG TTTTAATGAA

951 CGTGAATCCG ATATTCTTCA TCACCGTTCC CGACGTTCTG ACCGCCGCCG

1001 TGTTCATGCT TTACCTGCTG ACGTTCGTAC CGATTTTTCG AGCGAACGCG

1051 TTTACAGACG ATCCGGAATA A
```

This corresponds to the amino acid sequence <SEQ ID 854; ORF130ng-1>:

```
  1 MRPFFVGAAV LAILGALVFF INPGAIILHR QIFLELMLPA AYGGFLTTAL

51 LDRTGFSGNL KPAATLMAVL LLVAAVLLPF LPQLAAFFVA AYWLVLLLFC

101 AWLIWLDRNT DNFALLMLLA AFTVFQTAYA VSGDLNLLRA QVHLNMAAVM

151 FVSVRVSVLL GTETLKECRL KDPVFIPNVI YKNIAITLLL HAAAELWLPA

201 QTAGFTALAV GFILLAKLRE LHHHELLRKH YVRTYYLLQL FAAAGYLWTG

251 AAKLQNLPAS APLHLITLGG MTGGVMMVWL TAGLWHSGFT KLDYPKLCRI

301 AVSILFASAV SRAVLMNVNP IFFITVPEIL TAAVFMLYLL TFVPIFRANA

351 FTDDPE*
```

ORF130ng-1 and ORF130-1 show 92.4% identity in 357 aa overlap:

```
orf130-1.pep    MRPFFVGAAVLAILGALVFFINPGAIVLHRQIFLELMLPAAYGGFLTAALLDWTGFSGNL
                |||||||||||||||||||||||||||:||||||||||||||||||||:||||  ||||||
orf130ng-1      MRPFFVGAAVLAILGALVFFINPGAIILHRQIFLELMLPAAYGGFLTTALLDRTGFSGNL
orf130-1.pep    KPVATLMAALLLAASAILPFSPQTASFFVAAYWLVLLLFCARLIWLDRNTDNFALLMLLA
                ||:|||||:|||::|:|| ||::|:|||||||||||||||| ||||||||||||||||||
orf130ng-1      KPAATLMAVLLLVAAVLLPFLPQLAAFFVAAYWLVLLLFCAWLIWLDRNTDNFALLMLLA
orf130-1.pep    AFTVFQTAYAVSGDLNLLRAQVHLNMAAVMFVSVRVSILLGAEALKECRLKDPVFIPNIV
                ||||||||||||||||||||||||||||||||||||||:||:|:||||||||||||||::
orf130ng-1      AFTVFQTAYAVSGDLNLLRAQVHLNMAAVMFVSVRVSVLLGTETLKECRLKDPVFIPNVI
orf130-1.pep    YKNIAITFLLHAAAELWLPAQTAGFTALAVGFILLAKLRELHHHELLRKHYVRTYYLLQ
                |||||||  ||||||||||||||||||||||||||||||||||||||||||||||||||
orf130ng-1      YKNIAIT-LLHAAAELWLPAQTAGFTALAVGFILLAKLRELHHHELLRKHYVRTYYLLQ
orf130-1.pep    LFAAAGYLWTGAAKLQNLPASAPLGLITLGGMMGGVMMVWLTAGLWHSGFTKLDYPKLCR
                ||||||||||||||||||||||||||||||||:||||||||||||||||||||||||||
orf130ng-1      LFAAAGYLWTGAAKLQNLPASAPLGLITLGGMTGGVMMVWLTAGLWHSGFTKLDYPKLCR
orf130-1.pep    IAVPILFAAAVSRAFLMNVNPIFFITVPAILTAAVFVLYLFTFIPIFRANAFTDDPE
                |||  ||| :|||| ||||||||||||| ||||||| | :|| :|:|||||||||||
orf130ng-1      IAVSILFASAVSRAVLMNVNPIFFITVPEILTAAVFMLYLLTFVPIFRANAFTDDPE
```

Based on this analysis, it is predicted that the proteins from *N. meningitidis* and *N. gonorrhoeae*, and their epitopes, could be useful antigens for vaccines or diagnostics, or for raising antibodies.

Example 101

The following partial DNA sequence was identified in *N. meningitidis* <SEQ ID 855>:

```
  1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA
```

```
101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATAGT TCCGTCAGGG CAAACGAATA TGAATCCGCA CAACAATCTT

251 ACTTTTACAG GAAAATAGGG AAGTTTGAAG C.TGCGGGCT GGATTGGCGT

301 ACGCGTGACG GCAAACCTTT GATTGAGACG TTCAAACAGG GAGGATTTGA

351 CTGCTTGGAA AAG..
```

This corresponds to the amino acid sequence <SEQ ID 856; ORF131>:

```
  1 MEIRAIKYTA MAALLAFTVA GCRLAGWYEC SSLTGWCKPR KPAAIDFWDI

51 GGESPPSLGD YEIPLSDGNS SVRANEYESA QQSYFYRKIG KFEXCGLDWR

101 TRDGKPLIET FKQGGFDCLE K..
```

Further work revealed the complete nucleotide sequence <SEQ ID 857>:

```
  1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA

101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGCT GGATTGGCGT

301 ACGCGTGACG GCAAACCTTT GATTGAGACG TTCAAACAGG GAGGATTTGA

351 CTGCTTGGAA AAGCAGGGGT TGCGGCGCAA CGGTCTGTCC GAGCGCGTCC

401 GATGGTAA
```

This corresponds to the amino acid sequence <SEQ ID 858; ORF131-1>:

```
  1 MEIRAIKYTA MAALLAFTVA GCRLAGWYEC SSLTGWCKPR KPAAIDFWDI

51 GGESPPSLGD YEIPLSDGNR SVRANEYESA QQSYFYRKIG KFEACGLDWR

101 TRDGKPLIET FKQGGFDCLE KQGLRRNGLS ERVRW*
```

Computer analysis of this amino acid sequence gave the following results:

Homology with a Predicted ORF from *N. meningitidis* (Strain A)

ORF131 shows 95.0% identity over a 121 aa overlap with an ORF (ORF131a) from strain A of *N. meningitidis*:

```
                       10         20         30         40         50         60
    orf131.pep  MEIRAIKYTAMAALLAFTVAGCRLAGWYECSSLTGWCKPRKPAAIDFWDIGGESPPSLGD
                ||||||||||||||||||||||||||||||:|||||||||||||||||||||||||||||
    orf131a     MEIRAIKYTAMAALLAFTVAGCRLAGWYECSSLSGWCKPRKPAAIDFWDIGGESPPSLED
                       10         20         30         40         50         60
```

```
                       70         80         90        100        110        120
orf131.pep    YEIPLSDGNSSVRANEYESAQQSYFYRKIGKFEXCGLDWRTRDGKPLIETFKQGGFDCLE
              |||||||| |||||||||||||||||||||||| ||||||||||||||||||||| ||||:
orf131a       YEIPLSDGNRSVRANEYESAQQSYFYRKIGKFEACGLDWRTRDGKPLIETFKQEGFDCLK
                       70         80         90        100        110        120 orf131.pep    K
              |
orf131a       KQGLRRNGLSERVRWX
                             130
```

The complete length ORF131a nucleotide sequence <SEQ ID 859> is:

```
  1 ATGGAAATTC GGGCAATAAA ATATACGGCA ATGGCTGCGT TGCTTGCATT
 51 TACGGTTGCA GGCTGCCGGT TGGCAGGTTG GTATGAGTGT TCGTCCCTGT
101 CCGGCTGGTG TAAGCCGAGA AAACCTGCCG CCATCGATTT TTGGGATATT
151 GGCGGCGAGA GTCCTCCGTC TTTAGAGGAC TACGAGATAC CGCTTTCAGA
201 CGGCAATCGT TCCGTCAGGG CAAACGAATA TGAATCCGCA CAACAATCTT
251 ACTTTTACAG GAAAATAGGG AAGTTTGAAG CCTGCGGGTT GGATTGGCGT
301 ACGCGTGACG GCAAACCTTT GATTGAGACG TTCAAACAGG AAGGTTTTGA
351 TTGTTTGAAA AAGCAGGGGT TGCGGCGCAA CGGTCTGTCC GAGCGCGTCC
401 GATGGTAA
```

This encodes a protein having amino acid sequence <SEQ ID 860>:

```
  1 MEIRAIKYTA MAALLAFTVA GCRLAGWYEC SSLSGWCKPR KPAAIDFWDI
 51 GGESPPSLED YEIPLSDGNR SVRANEYESA QQSYFYRKIG KFEACGLDWR
101 TRDGKPLIET FKQEGFDCLK KQGLRRNGLS ERVRW*
```

ORF131a and ORF131-1 show 97.0% identity in 135 aa overlap:

```
orf131a.pep   MEIRAIKYTAMAALLAFTVAGCRLAGWYECSSLSGWCKPRKPAAIDFWDIGGESPPSLED
              |||||||||||||||||||||||||||||||:||||||||||||||||||||||||| |
orf131-1      MEIRAIKYTAMAALLAFTVAGCRLAGWYECSSLTGWCKPRKPAAIDFWDIGGESPPSLGD
orf131a.pep   YEIPLSDGNRSVRANEYESAQQSYFYRKIGKFEACGLDWRTRDGKPLIETFKQEGFDCLK
              |||||||||||||||||||||||||||||||||||||||||||||||||||||| ||||:
orf131-1      YEIPLSDGNRSVRANEYESAQQSYFYRKIGKFEACGLDWRTRDGKPLIETFKQGGFDCLE
orf131a.pep   KQGLRRNGLSERVRWX
              ||||||||||||||||
orf131-1      KQGLRRNGLSERVRWX
```

Homology with a Predicted ORF from *N. gonorrhoeae*

ORF131 shows 89.3% identity over 121 aa overlap with a predicted ORF (ORF131ng) from *N. gonorrhoeae*:

```
orf131.pep    MEIRAIKYTAMAALLAFTVAGCRLAGWYECSSLTGWCKPRKPAAIDFWDIGGESPPSLGD   60
              ||||:|||| |||:||||||||||||||||| :||||||||||||||||||||||| ||
orf131ng      MEIRVIKYTATAALFAFTVAGCRLAGWYECLSLSGWCKPRKPAAIDFWDIGGESPLSLED   60
```

```
-continued
orf131.pep    YEIPLSDGNSSVRANEYESAQQSYFYRKIGKFEXCGLDWRTRDGKPLIETFKQGGFDCLE  120
              ||||||||| |||||||||||||||:||||||||| |||||||||||||:| ||| ||||||
orf131ng      YEIPLSDGNRSVRANEYESAQKSYFYRKIGKFEACGLDWRTRDGKPLVERFKQEGFDCLE  120 orf131.pep    K                           121
              |
orf131ng      KQGLRRNGLSERVRW             134
```

A complete length ORF131ng nucleotide sequence <SEQ ID 861> was predicted to encode a protein having amino acid sequence <SEQ ID 862>:

```
  1  MEIRVIKYTA TAALFAFTVA GCRLAGWYEC LSLSGWCKPR KPAAIDFWDI
 51  GGESPLSLED YEIPLSDGNR SVRANEYESA QKSYFYRKIG KFEACGLDWR
101  TRDGKPLVER FKQEGFDCLE KQGLRRNGLS ERVRW*
```

Further work revealed the following gonococcal DNA sequence <SEQ ID 863>:

```
  1  ATGGAAATTC GGGTAATAAA ATATACGGCA ACGGCTGCGT TGTTTGCATT
 51  TACGGTTGCA GGCTGCCGGC TGGCGGGGTG GTATGAGTGT TCGTCCTTGT
101  CCGGCTGGTG TAAGCCGAGA AAACCTGCCG CCATCGATTT TTGGGATATT
151  GGCGGCGAGA GtccgctGTC TTTAGAGGAC TACGAGATAC CGCTTTCAGA
201  CGGCAATCGT TCCGTCAGGG CAAACGAATA TGAATCCGCG CAAAAATCTT
251  ACTTTTATAG GAAAATAGGG AAGTTTGAAG CCTGCGGGTT GGATTGGCGT
301  ACGCGTGACG GCAAACCTTT GGTTGAGAGG TTCAAACAGG AAGGTTTCGA
351  CTGTTTGGAA AAGCAGGGGT TGCGGCGCAA CGGCCTGTCC GAGCGCGTCC
401  GATGGTAA
```

This corresponds to the amino acid sequence <SEQ ID 864; ORF131ng-1>:

```
  1  MEIRVIKYTA TAALFAFTVA GCRLAGWYEC SSLSGWCKPR KPAAIDFWDI
 51  GGESPLSLED YEIPLSDGNR SVRANEYESA QKSYFYRKIG KFEACGLDWR
101  TRDGKPLVER FKQEGFDCLE KQGLRRNGLS ERVRW*
```

ORF131ng-1 and ORF131-1 show 92.6% identity in 135 aa overlap:

```
orf131ng-1.pep  MEIRVIKYTATAALFAFTVAGCRLAGWYECSSLSGWCKPRKPAAIDFWDIGGESPLSLED
                ||| :||||| |||:||||||||||||||||||:||||||||||||||||||||| || |
orf131-1        MEIRAIKYTAMAALLAFTVAGCRLAGWYECSSLTGWCKPRKPAAIDFWDIGGESPPSLGD orf131ng-1.pep  YEIPLSDGNRSVRANEYESAQKSYFYRKIGKFEACGLDWRTRDGKPLVERFKQEGFDCLE
                |||||||||||||||||||||:||||||||||||||||||||||||||:| |||||||||
orf131-1        YEIPLSDGNRSVRANEYESAQQSYFYRKIGKFEACGLDWRTRDGKPLIETFKQGGFDCLE
```

```
orf131ng-1.pep    KQGLRRNGLSERVRWX
                  ||||||||||||||||
orf131-1          KQGLRRNGLSERVRWX
```

Based on the presence of a predicted prokaryotic membrane lipoprotein lipid attachment site, it is predicted that the proteins from *N. meningitidis* and *N. gonorrhoeae*, and their epitopes, could be useful antigens for vaccines or diagnostics, or for raising antibodies.

Example 102

The following partial DNA sequence was identified in *N. meningitidis* <SEQ ID 865>

```
  1 ATGAAACACA TCCATATTAT CGGTATCGGC GGCACGTTTA TGGGCGGGCT
 51 TGCCGCCATT GCCAAAGAAG CGGGGTTTGA AGTCAGCGGT TGCGACGCGA
101 AGATGTATCC GCCGATGAGC ACCCAGCTCG AAGCCTTGGG TATAGACGTG
151 TATGAAGGCT TCGATGCCGC TCAGTTGGAC GAATTTAAAG CCGACGTTTA
201 CGTTATCGGC AATGTCGCCA AGCGCGGGAT GGATGTGGTT GAAGCGATTT
251 TGAACCTCGG CCTGCCtTAT ATtTcCGGCC CGCAATGGCT GTCGGAAAAC
301 GTGCTGCACC ATCATTGGGT ACTCGGTGTG GCGGGGACgC ACGGCAAAAC
351 GACCACCGCC TCCATGCTCG CATGGGTCTT GGAATATgCC GGCCTCGCGC
401 CGGGCTTCCT TATtGGCGGC GTACC.GGAA AATttCGGCG TTTCCGCCCG
451 CCTGCCGCAA ACGCCGCGCC AAGACCCGAA CAGCCAATCG CCGTTTTTcG
501 TCATCGAAGC CGACGAATAC GACACCGCCT TTtTCGACAA ACGTTCTAAA
551 TtCGTGCATT ACCGTCCGCG TACCGCCGTG TTGAACAATC TGGAATTCGA
601 CCACGCCGAC ATCTTTGCCG ACTTGGGCGC GATACAGACc CAGTTCCACT
651 ACCTCGTGCG TACCGTGCCG TCTGAAGGCT TAATCGTCTG CAACGGACGG
701 CAGCAAAGCC TGCAAGATAC TTTGGACAAA GGCTGCTGGA CGCCGGTGGA
751 AAAATTCGGC ACGGAACACG GCTGGCA..
```

This corresponds to the amino acid sequence <SEQ ID 866; ORF132>:

```
  1 MKHIHIIGIG GTFMGGLAAI AKEAGFEVSG CDAKMYPPMS TQLEALGIDV
 51 YEGFDAAQLD EFKADVYVIG NVAKRGMDVV EAILNLGLPY ISGPQWLSEN
101 VLHHHWVLGV AGTHGKTTTA SMLAWVLEYA GLAPGFLIGG VXGKFRRFRP
151 PAANAAPRPE QPIAVFRHRS RRIRHRLFRQ TFXIRALPSA YRRVEQSGIR
201 PRRHLCRLGR DTDPVPLPRA YRAVXRLNRL QRTAAKPARY FGQRLLDAGG
251 KIRHGTRLA..
```

Further work revealed the complete nucleotide sequence <SEQ ID 867>:

```
   1 ATGAAACACA TCCATATTAT CGGTATCGGC GGCACGTTTA TGGGCGGGCT

51 TGCCGCCATT GCCAAAGAAG CGGGGTTTGA AGTCAGCGGT TGCGACGCGA

101 AGATGTATCC GCCGATGAGC ACCCAGCTCG AAGCCTTGGG TATAGACGTG

151 TATGAAGGCT TCGATGCCGC TCAGTTGGAC GAATTTAAAG CCGACGTTTA

201 CGTTATCGGC AATGTCGCCA AGCGCGGGAT GGATGTGGTT GAAGCGATTT

251 TGAACCTCGG CCTGCCTTAT ATTTCCGGCC CGCAATGGCT GTCGGAAAAC

301 GTGCTGCACC ATCATTGGGT ACTCGGTGTG GCGGGGACGC ACGGCAAAAC

351 GACCACCGCC TCCATGCTCG CATGGGTCTT GGAATATGCC GGCCTCGCGC

401 CGGGCTTCCT TATTGGCGGC GTACCGGAAA ATTTCGGCGT TCCGCCCGC

451 CTGCCGCAAA CGCCGCGCCA AGACCCGAAC AGCCAATCGC CGTTTTTCGT

501 CATCGAAGCC GACGAATACG ACACCGCCTT TTTCGACAAA CGTTCTAAAT

551 TCGTGCATTA CCGTCCGCGT ACCGCCGTGT TGAACAATCT GGAATTCGAC

601 CACGCCGACA TCTTTGCCGA CTTGGGCGCG ATACAGACCC AGTTCCACTA

651 CCTCGTGCGT ACCGTGCCGT CTGAAGGCTT AATCGTCTGC AACGGACGGC

701 AGCAAAGCCT GCAAGATACT TTGGACAAAG GCTGCTGGAC GCCGGTGGAA

751 AAATTCGGCA CGGAACACGG CTGGCAGGCC GGCGAAGCCA ATGCCGACGG

801 CTCGTTCGAC GTGTTGCTCG ACGGCAAAAC CGCCGGACGC GTCAAATGGG

851 ATTTGATGGG CAGGCACAAC CGCATGAACG CGCTCGCCGT CATTGCCGCC

901 GCGCGTCATG TCGGTGTCGA TATTCAGACC GCCTGCGAAG CCTTGGGCGC

951 GTTTAAAAAC GTCAAACGCC GGATGGAAAT CAAAGGCACG GCAAACGGCA

1001 TCACCGTTTA CGACGACTTC GCCCACCACC CGACCGCCAT CGAAACCACG

1051 ATTCAAGGTT TGCGCCAACG CGTCGGCGGC GCGCGCATCC TCGCCGTCCT

1101 CGAACCGCGT TCCAACACGA TGAAGCTGGG CACGATGAAG TCCGCCCTGC

1151 CTGTAAGCCT CAAAGAAGCC GACCAAGTGT TCTGCTACGC CGGCGGCGTG

1201 GACTGGGACG TCGCCGAAGC CCTCGCGCCT TTGGGCGGCA GGCTGAACGT

1251 CGGCAAAGAC TTCGATGCCT TCGTTGCCGA AATCGTGAAA AACGCCGAAG

1301 TAGGCGACCA TATTTTGGTG ATGAGCAACG GCGGTTTCGG CGGAATACAC

1351 GGAAAGCTGC TGGAAGCTTT GAGATAG
```

This corresponds to the amino acid sequence <SEQ ID 868; ORF132-1>:

```
   1 MKHIHIIGIG GTFMGGLAAI AKEAGFEVSG CDAKMYPPMS TQLEALGIDV

51 YEGFDAAQLD EFKADVYVIG NVAKRGMDVV EAILNLGLPY ISGFQWLSEN

101 VLHHHWVLGV AGTHGKTTTA SMLAWVLEYA GLAPGFLIGG VPENFGVSAR

151 LPQTPRQDPN SQSFFFVIEA DEYDTAFFDK RSKFVHYRPR TAVLNNLEFD

201 HADIFADLGA IQTQFHYLVR TVPSEGLIVC NGRQQSLQDT LDKGCWTPVE

251 KFGTEHGWQA GEANADGSFD VLLDGKTAGR VKWDLMGRHN RMNALAVIAA

301 ARHVGVDIQT ACEALGAFKN VKRRMEIKGT ANGITVYDDF AHHPTAIETT
```

-continued

```
351 IQGLRQRVGG ARILAVLEPR SNTMKLGTMK SALPVSLKEA DQVFCYAGGV

401 DWDVAEALAP LGGRLNVGKD FDAFVAEIVK NAEVGDHILV MSNGGFGGIH

451 GKLLEALR*
```

Computer analysis of this amino acid sequence gave the following results:

Homology with the Hypothetical o457 Protein of *E. coli* [10] (Accession Number U14003)

ORF132 and o457 show 58% aa identity in 140 aa overlap:

```
Orf132:    4 IHIIGIGGTFMGGLAAIAKEAGFEVSGCDAKMYPPMSTQLEALGIDVYEGFDAAQLDEFK   63
             IH+GI GTFMGGGLA +A++ F EV+G DA +YPPMST LE  GI++ +G+DA+QL+  +
o457:      3 IHILGICGTFMGGLAMLARQLGHEVTGSDANVYPPMSTLLEKQGIELIQGYDASQLEP-Q   61

Orf132:   64 ADVYVIGNVAKRGMDVVEAILNLGLPYISGPQWLSENVLHHHWVLGVAGTHGKTTTASML  123
             D+ +IGN  RG  VEA+L  +PY+SGPQWL + VL   WVL VAGTHGKTTTA M
o457:     62 PDLVIIGNAMTRGNPCVEAVLEKNIPYMSGPQWLHDFVLRDRWVLAVAGTHGKTTTAGMA  121

Orf132:  124 AWVLEYAGLAPGFLIGGVXG                                          143
             W+LE  G  PGF+IGGV G
o457:    122 TWILEQCGYKPGFVIGGVPG                                          141
```

Homology with a Predicted ORF from *N. meningitidis* (Strain A)

ORF132 shows 74.6% identity over a 189aa overlap with an ORF (ORF132a) from strain A of *N. meningitidis*:

```
                     10        20        30        40        50        60
orf132.pep   MKHIHIIGIGGTFMGGLAAIAKEAGFEVSGCDAKMYPPMSTQLEALGIDVYEGFDAAQLD
             ||||||||||||||||||:|||||||||| |||||||||||||||||||||||:||||
orf132a      MKHIHIIGIGGTFMGGIAAIAKEAGFEXSGCDAKMYPPMSTQLEALGIGVYEGFDTAQLD
                     10        20        30        40        50        60

70        80        90       100       110       120
orf132.pep   EFKADVYVIGNVAKRGMDVVEAILNLGLPYISGPQWLSENVLHHHWVLGVAGTHGKTTTA
             |||||||||||||||||||||||||:|||||||||||  |:|||||| ||||| |||||
orf132a      EFKADVYVIGNVAKRGMDVVEAILNRGLPYISGPQWLAENXLHHHWXLGVAXTHGKTTTA
                     70        80        90       100       110       120

130       140       150       160
orf132.pep   SMLAWVLEYAGLAPGFLIGGVXGKFR---RFRPPAANAAPRPEQPI----------AVFR
             |||||||||||||||| ||||   :|   |: |  :    | ::|:          | |
orf132a      SMLAWVLEYAGLAPGFXIGGVPENFSVSARL-PQTPRQDPNSQSPFFVIEADEYDTAFFD
                    130       140       150       160       170

170       180       190       200       210       220
orf132.pep   HRSRRIRHRLFRQTFXIRALPSAYRRVEQSGIRPRRHLCRLGRDTDPVPLPRAYRAVXRL
             :||:  :::|
orf132a      KRSKFVHYRPRTAVLNNLEFDHADIFADLGAIQTQFHHLVRTVPSEGLIVCNGRQQSLQD
                    180       190       200       210       220       230
```

The complete length ORF132a nucleotide sequence <SEQ ID 869> is:

```
  1 ATGAAACACA TCCACATTAT CGGTATCGGC GGCACGTTTA TGGGTGGGAT

51 TGCCGCCATT GCCAAAGAAG CAGGGTTTGA ANTCAGCGGT TGCGATGCGA

101 AGATGTATCC GCCGATGAGC ACCCAGCTCG AAGCCTTGGG CATAGGCGTG

151 TATGAAGGCT TCGACACCGC GCAGTTGGAC GAATTTAAAG CCGACGTTTA

201 CGTTATCGGC AATGTCGCCA AGCGCGGGAT GGATGTGGTT GAAGCGATTT

251 TGAACCGTGG GCTGCCTTAT ATTTCCGGCC CGCAATGGCT GGCTGAAAAC

301 NTGCTGCACC ATCATTGGNN ACTCGGCGTG GCGGNGACGC ACGGCAAAAC
```

```
-continued
 351 GACCACCGCG TCTATGCTCG CGTGGGTTTT GGAATATGCC GGACTCGCAC

401 CGGGCTTCNT TATCGGCGGC GTACCGGAAA ACTTCAGCGT TTCCGCCCGC

451 CTGCCGCAAA CGCCGCGCCA AGACCCGAAC AGCCAATCGC CGTTTTTCGT

501 CATTGAAGCC GACGAATACG ACACCGCGTT TTTCGACAAA CGCTCCAAAT

551 TCGTGCATTA CCGTCCGCGT ACCGCCGTGT TGAACAATCT GGAATTCGAC

601 CACGCCGACA TCTTCGCCGA TTTGGGCGCG ATACAGACCC AGTTCCACCA

651 CCTCGTGCGT ACCGTGCCGT CTGAAGGCCT CATCGTCTGC AACGGACGGC

701 AGCAAAGCCT GCAAGACACT TGGACAAAG GCTGCTGGAC GCCGGTGGAA

751 AAATTCGGCA CGGAACACGG CTGGCAGGCC GGCGAAGCCA ATGCCGATGG

801 CTCGTTCGAC GTGTTGCTTG ACGGCAAAAA AGCCGGACAC GTCGCTTGGA

851 GTTTGATGGG CGGACACAAC CGCATGAACG CGCTCGCNGT CATCGCCGCC

901 GCGCGTCATG CCGGAGTNGA CATTCAGACG GCCTGCGAAG CCTTGAGCAC

951 GTTTAAAAAC GTCAAACGCC GCATGGAAAT CAAAGGCACG GCAAACGGTA

1001 TCACCGTTTA CGACGACTTC GCCCACCATC CGACCGCTAT CGAAACCACG

1051 ATTCAAGGTT TGCGCCAGCG CGTCGGCGGC GCGCGCATCC TCGCCGTCCT

1101 CGAACCGCGT TCCAATACGA TGAAGCTGGG TACGATGAAA GCCGCCCTGC

1151 CCGCAAGCCT CAAAGAAGCC GACCAAGTGT TCTGNTACGC CGGCGGCGCG

1201 GACTGGGACG TTGCCGAAGC CCTCGCGCCT TGGGCGGCA GGCTGCACGT

1251 CGGCAAAGAC TTCGATGCCT TCGTTGCCGA AATCGTGAAA AACGCCGAAG

1301 CAGGCGACCA TATTTTGGTG ATGAGCAACG GCGGTTTCGG CGGAATACAC

1351 ACCAAACTGC TGGACGCTTT GAGATAG
```

This encodes a protein having amino acid sequence <SEQ ID 870>:

```
  1 MKHIHIIGIG GTFMGGIAAI AKEAGFEXSG CDAKMYPPMS TQLEALGIGV

51 YEGFDTAQLD EFKADVYVIG NVAKRGMDVV EAILNRGLPY ISGFQWLAEN

101 XLHHHWXLGV AXTHGKTTTA SMLAWVLEYA GLAPGFXIGG VPENFSVSAR

151 LPQTPRQDPN SQSPFFVIEA DEYDTAFFDK RSKFVHYRPR TAVLNNLEFD

201 HADIFADLGA IQTQFHHLVR TVPSEGLIVC NGRQQSLQDT LDKGCWTPVE

251 KFGTEHGWQA GEANADGSFD VLLDGKKAGH VAWSLMGGHN RMNALAVIAA

301 ARHAGVDIQT ACEALSTFKN VKRRMEIKGT ANGITVYDDF AHHPTAIETT

351 IQGLRQRVGG ARILAVLEPR SNTMKLGTMK AALPASLKEA DQVFXYAGGA

401 DWDVAEALAP LGGRLHVGKD FDAFVAEIVK NAEAGDHILV MSNGGFGGIH

451 TKLLDALR*
```

ORF132a and ORF132-1 show 93.9% identity in 458 aa overlap:

```
orf132a.pep    MKHIHIIGIGGTFMGGIAAIAKEAGFEXSGCDAKMYPPMSTQLEALGIGVYEGFDTAQLD
               ||||||||||||||||:||||||||| ||||||||||||||||||| ||||||:||||
orf132-1       MKHIHIIGIGGTFMGGLAAIAKEAGFEVSGCDAKMYPPMSTQLEALGIDVYEGFDAAQLD orf132a.pep    EFKADVYVIGNVAKRGMDVVEAILNRGLPYISGPQWLAENXLHHHWXLGVAXTHGKTTTA
               ||||||||||||||||||||||||| ||||||||||||:|| |||| |||| ||||||
orf132-1       EFKADVYVIGNVAKRGMDVVEAILNLGLPYISGPQWLSENVLHHHWVLGVAGTHGKTTTA orf132a.pep    SMLAWVLEYAGLAPGFXIGGVPENFSVSARLPQTPRQDPNSQSPFFVIEADEYDTAFFDK
               ||||||||||||||||| ||||||| :|||||||||||||||||||||||||||||||
orf132-1       SMLAWVLEYAGLAPGFLIGGVPENFGVSARLPQTPRQDPNSQSPFFVIEADEYDTAFFDK orf132a.pep    RSKFVHYRPRTAVLNNLEFDHADIFADLGAIQTQFHHLVRTVPSEGLIVCNGRQQSLQDT
               ||||||||||||||||||||||||||||||||||:|||||||||||||||||||||||
orf132-1       RSKFVHYRPRTAVLNNLEFDHADIFADLGAIQTQFHYLVRTVPSEGLIVCNGRQQSLQDT orf132a.pep    LDKGCWTPVEKFGTEHGWQAGEANADGSFDVLLDGKKAGHVAWSLMGGHNRMNALAVIAA
               |||||||||||||||||||||||||||||||||||: |||  :||| |||||||||||
orf132-1       LDKGCWTPVEKFGTEHGWQAGEANADGSFDVLLDGKTAGRVKWDLMGRHNRMNALAVIAA orf132a.pep    ARHAGVDIQTACEALSTFKNVKRRMEIKGTANGITVYDDFAHHPTAIETTIQGLRQRVGG
               |||:||||||||||  ::||||||||||||||||||||||||||||||||||||||||
orf132-1       ARHVGVDIQTACEALGAFKNVKRRMEIKGTANGITVYDDFAHHPTAIETTIQGLRQRVGG orf132a.pep    ARILAVLEPRSNTMKLGTMKAALPASLKEADQVFXYAGGADWDVAEALAPLGGRLHVGKD
               |||||||||||||||||||| :|| :|||||||| |||| ||||||||||||||:|||
orf132-1       ARILAVLEPRSNTMKLGTMKSALPVSLKEADQVFCYAGGVDWDVAEALAPLGGRLNVGKD orf132a.pep    FDAFVAEIVKNAEAGDHILVMSNGGFGGIHTKLLDALRX
               ||||||||||||:|||||||||||||||| ||:||||
orf132-1       FDAFVAEIVKNAEVGDHILVMSNGGFGGIHGKLLEALRX
```

Homology with a Predicted ORF from *N. gonorrhoeae*
ORF132 shows 89.6% identity over 259 aa overlap with a predicted ORF (ORF132ng) from *N. gonorrhoeae*:

```
orf132.pep     MKHIHIIGIGGTFMGGLAAIAKEAGFEVSGCDAKMYPPMSTQLEALGIDVYEGFDAAQLD    60
               ||||||||||||||||:|||||||||:||||||||||||||||||||:|:|||||||||:
orf132ng       MKHIHIIGIGGTFMGGIAAIAKEAGFKVSGCDAKMYPPMSTQLEALGIGVHEGFDAAQLE    60 orf132.pep     EFKADVYVIGNVAKRGMDVVEAILNLGLPYISGPQWLSENVLHHHWVLGVAGTHGKTTTA   120
               ||:||||||||||:|||||||||||:||||||||||:|||||||||||||||||||||||
orf132ng       EFQADIYVIGNVARRGMDVVEAILNRGLPYISGPQWLAENVLHHHWVLGVAGTHGKTTTA   120 orf132.pep     SMLAWVLEYAGLAPGFLIGGVXGKFRRFRPPAANAAPRPEQPIAVFRHRSRRIRHRLFRQ   180
               ||||||||||||||||||||| ||||||||| ||| |||| :|||||||||||||||||
orf132ng       SMLAWVLEYAGLAPGFLIGGVPGKFRRFRPPTANAASRPEQQIAVFRHRSRRIRHRLFRQ   180 orf132.pep     TFXIRALPSAYRRVEQSGIRPRRHLCRLGRDTDPVPLPRAYRAVXRLNRLQRTAAKPARY   240
               |:|||| ||||||||||||||||||| |||||||||  |||:::| |:|||||||||||
orf132ng       TLQIRALSPAYRRVEQSGIRPRRHLRRLGRDTDPVPPPRAHRTIRRPHRLQRTAAKPARY   240 orf132.pep     FGQRLLDAGGKIRHGTRLA             259
               ||||||||||||||| |||
orf132ng       FGQRLLDAGGKIRHRTRLADW           261
```

An ORF132ng nucleotide sequence <SEQ ID 871> was predicted to encode a protein having amino acid sequence <SEQ ID 872>:

```
  1 MKHIHIIGIG GTFMGGIAAI AKEAGFKVSG CDAKMYPPMS TQLEALGIGV

51 HEGFDAAQLE EFQADIYVIG NVARRGMDVV EAILNRGLPY ISGPQWLAEN

101 VLHHHWVLGV AGTHGKTTTA SMLAWVLEYA GLAPGFLIGG VPGKFRRFRP

151 PTANAASRPE QQIAVFRHRS RRIRHRLFRQ TLQIRALSPA YRRVEQSGIR

201 PRRHLRRLGR DTDPVPPPRA HRTIRRPHRL QRTAAKPARY FGQRLLDAGG

251 KIRHRTRLAD W*
```

Further work revealed the following gonococcal DNA sequence <SEQ ID 873>:

```
  1 ATGAAACACA TCCACATTAT CGGTATCGGC GGCACGTTTA TGGGCGGGAT
 51 TGCCGCCATT GCCAAAGAAG CCGGGTTCAA AGTCAGCGGT TGCGACGCGA
101 AGATGTATCC GCCGATGAGC ACCCAGCTCG AAGCCTTGGG CATAGGCGTA
151 CACGAAGGCT TCGATGCCGC GCAGTTGGAA GAATTTCAAG CCGATATTTA
201 CGTCATCGGC AATGTCGCCA GGCGCGGGAT GGATGTGGTC GAGGCGATTT
251 TGAACCGTGG GCTGCCTTAT ATTTCCGGCC CGCAATGGCT GGCTGAAAac
301 GTGCtgcacc atcaTTGGgt ACTCGGCGTG GcagggaCGC ACGGcaaAac
351 gaccaCcGcg tCCATGCTCG CCTGGGTCTT GGAATATGCC GGACTCGCGC
401 CGGGCTTCCT CATCGGCGGt gtaccggaAA ATTTCGGCGT TCCGCCCGC
451 CTACCGCAAA CGCCGCGTCA AGACCCGAAC AGCAAATCGC CGTTTTTCGT
501 CATCGAAGCC GACGAATACG ACACCGCCTT TTTCGACAAA CGCTCCAAAT
551 TCGTGCATTA TCGCCCGCGT ACCGCCGTGT TGAACAATCT GGAATTCGAC
601 CACGCCGACA TCTTCGCCGA CTTGGGCGCG ATACAGACCC AGTTCCACCA
651 CCTCGTGCGC ACCGTACCAT CCGAAGGCCT CATCGTCTGC AACGGACAGC
701 AGCAAAGCCT GCAAGATACT TTGGACAAAG GCTGCTGGAC GCCGGTGGAA
751 AAATTCGGCA CCGGACACGG CTGGCAGATT GGTGAAGTCA ATGCCGACGG
801 CTCGTTCGAC GTATTGCTTG ACGGCAAAAA AGCCGGACAC GTCGCATGGG
851 ATTTGATGGG CGGACACAAC CGCATGAACG CGCTCGCCGT CATCGCTGCC
901 GCACGCCATG CCGGAGTCGA TGTTCAGACG GCCTGCGAAG CCTTGGGTGC
951 GTTTAAAAAC GTCAAACGCC GCATGGAAAT CAAAGGCACG GCAAACGGCA
1001 TCACCGTTTA CGACGATTTC GCCCACCACC CGACCGCCAT CGAAACCACG
1051 ATTCAAGGTT GCGCCAACG TGTCGGCGGC GCGCGCATCC TCGCCGTCCT
1101 CGAGCCGCGT TCCAACACCA TGAAACTCGG CACGATGAAG TCCGCCCTGC
1151 CCGCAAGCCT CAAAGAAGCC GACCAAGTGT TCTGCTACGC CGGCGGCGCG
1201 GACTGGGACG TTGCCGAAGC CCTCGCGCCT TTGGGCTGCA GGCTGCGCGT
1251 CGGTAAAGAT TTCGATACCT TCGTTGCCGA AATTGTGAAA AACGCCCGAA
1301 CCGGCGACCA TATTTTGGTG ATGAGCAACG GCGGTTTCGG CGGAATACAC
1351 ACCAAACTGC TGGACGCTTT GAGATAG
```

This corresponds to the amino acid sequence <SEQ ID 874; ORF132ng-1>:

```
  1 MKHIHIIGIG GTFMGGIAAI AKEAGFKVSG CDAKMYPPMS TQLEALGIGV
 51 HEGFDAAQLE EFQADIYVIG NVARRGMDVV EAILNRGLPY ISGPQWLAEN
101 VLHHWVLGV AGTHGKTTTA SMLAWVLEYA GLAPGFLIGG VPENFGVSAR
151 LPQTPRQDPN SKSPFFVIEA DEYDTAFFDK RSKFVHYRPR TAVLNNLEFD
201 HADIFADLGA IQTQFHHLVR TVPSEGLIVC NGQQQSLQDT LDKGCWTPVE
251 KFGTGHGWQI GEVNADGSFD VLLDGKKAGH VAWDLMGGHN RMNALAVIAA
301 ARHAGVDVQT ACEALGAFKN VKRRMEIKGT ANGITVYDDF AHHPTAIETT
```

-continued
```
351 IQGLRQRVGG ARILAVLEPR SNTMKLGTMK SALPASLKEA DQVFCYAGGA

401 DWDVAEALAF LGCRLRVGKD FDTFVAEIVK NARTGDHILV MSNGGFGGIH

451 TKLLDALR*
```

ORF132ng-1 and ORF132-1 show 93.2% identity in 458 aa overlap:

```
orf132ng-1.pep    MKHIHIIGIGGTFMGGIAAIAKEAGFKVSGCDAKMYPPMSTQLEALGIGVHEGFDAAQLE
                  ||||||||||||||||:||||||:|||||||||||||||||||||||| |:||||||| :
orf132-1          MKHIHIIGIGGTFMGGLAAIAKEAGFEVSGCDAKMYPPMSTQLEALGIDVYEGFDAAQLD orf132ng-1.pep    EFQADIYVIGNVARRGMDVVEAILNRGLPYISGPQWLAENVLHHHWVLGVAGTHGKTTTA
                  ||:||:|||||||:|||||||||||:||||||||||||:|||||||||||||||||||||
orf132-1          EFKADVYVIGNVAKRGMDVVEAILNLGLPYISGPQWLSENVLHHHWVLGVAGTHGKTTTA orf132ng-1.pep    SMLAWVLEYAGLAPGFLIGGVPENFGVSARLPQTPRQDPNSKSPFFVIEADEYDTAFFDK
                  ||||||||||||||||||||||||||||||||||||||||||:|||||||||||||||||
orf132-1          SMLAWVLEYAGLAPGFLIGGVPENFGVSARLPQTPRQDPNSQSPFFVIEADEYDTAFFDK orf132ng-1.pep    RSKFVHYRPRTAVLNNLEFDHADIFADLGAIQTQFHHLVRTVPSEGLIVCNGQQQSLQDT
                  ||||||||||||||||||||||||||||||||||||:|||||||||||||||:|||||||
orf132-1          RSKFVHYRPRTAVLNNLEFDHADIFADLGAIQTQFHYLVRTVPSEGLIVCNGRQQSLQDT orf132ng-1.pep    LDKGCWTPVEKFGTGHGWQIGEVNADGSFDVLLDGKKAGHVAWDLMGGHNRMNALAVIAA
                  |||||||||||||||| |||   ||:||||||||||:|||:|||||  |||||||||||
orf132-1          LDKGCWTPVEKFGTEHGWQAGEANADGSFDVLLDGKTAGRVKWDLMGRHNRMNALAVIAA orf132ng-1.pep    ARHAGVDVQTACEALGAFKNVKRRMEIKGTANGITVYDDFAHHPTAIETTIQGLRQRVGG
                  |||:||||:|||||||||||||||||||||||||||||||||||||||||||||||||||
orf132-1          ARHVGVDIQTACEALGAFKNVKRRMEIKGTANGITVYDDFAHHPTAIETTIQGLRQRVGG orf132ng-1.pep    ARILAVLEPRSNTMKLGTMKSALPASLKEADQVFCYAGGADWDVAEALAPLGCRLRVGKD
                  |||||||||||||||||||||||:|||||||||||||||:||||||||||||||:||||
orf132-1          ARILAVLEPRSNTMKLGTMKSALPVSLKEADQVFCYAGGVDWDVAEALAPLGGRLNVGKD orf132ng-1.pep    FDTFVAEIVKNARTGDHILVMSNGGFGGIHTKLLDALRX
                  ||:||||||||::||||||||||||||||||  |||:|||
orf132-1          FDAFVAEIVKNAEVGDHILVMSNGGFGGIHGKLLEALRX
```

In addition, ORF132ng-1 is homologous to a hypothetical E. coli protein:

```
pir||S56459 hypothetical protein o457 - Escherichia coli >gi|537075
(U14003) ORF_o457 [Escherichia coli] >gi|1790680 (AE000494) hypothetical
48.5 kD protein in fbp-pmbA intergenic region [Escherichia coli]
Length = 457  Score = 474 hits (1207), Expect = e-133
Identities = 249/439 (56%), Positives = 294/439 (66%), Gaps = 13/439 (2%)

Query:  22 KEAGFKVSGCDAKMYPPMSTQLEALGIGVHEGFDAAQLEEFQADIYVIGNVARRGMDVVE  81
           ++ G +V+G DA +YPPMST LE  GI + +G+DA+QLE  Q D+ +IGN  RG    VE
Sbjct:  21 RQLGHEVTGSDANVYPPMSTLLEKQGIELIQGYDASQLEP-QPDLVIIGNAMTRGNPCVE  79

Query:  82 AILNRGLPYISGPQWLAENVLHHHWVLGVAGTHGKTTTASMLAWVLEYAGLAPGFLIGGV 141
           A+L + +PY+SGPQWL + VL   WVL VAGTHGKTTTA M W+LE  G  PGF+IGGV
Sbjct:  80 AVLEKNIPYMSGPQWLHDFVLRDRWVLAVAGTHGKTTTAGMATWILEQCGYKPGFVIGGV 139

Query: 142 PENFGVSARLPQTPRQDPNSKSPFFVIEADEYDTAFFDKRSKFVHYRPRTAVLNNLEFDH 201
           P NF VSA L           +S FFVIEADEYD AFFDKRSKFVHY PRT +LNNLEFDH
Sbjct: 140 PGNFEVSAHL---------GESDFFVIEADEYDCAFFDKRSKFVHYCPRTLILNNLEFDH 190

Query: 202 ADIFADLGAIQTQFHHLVRTVPSEGLIVCNGQQQSLQDTLDKGCWTPVEKFGTGHGWQIG 261
           ADIF DL AIQ QFHHLVR VP +G I+    +L +T+  GCW+  E G   WQ +
Sbjct: 191 ADIFDDLKAIQKQFHHLVRIVPGQGRIIWPENDINLKQTMANGCWSEQELVGEQGHWQAK 250

Query: 262 EVNADGS-FDVLLDGKKAGHVAWDLMGGHNRMNALAVIAAARHAGVDVQTACEALGAFKN 320
           ++  D S ++VLLDG+K G V W L+G HN  N L  IAAARH GV  A   ALG+F N
Sbjct: 251 KLTTDASEWEVLLDGEKVGEVKWSLVGEHNMHNGLMAIAAARHVGVAPADAANALGSFIN 310

Query: 321 VKRRMEIKGTANGITVYDDFAHHPTAIETTIQGLRQRVGG-ARILAVLEPRSNTMKLGTM 379
            +RR+E++G ANG TVYDDFAHHPTAI  T+  LR +VGG ARI+AVLEPRSNTMK+G
Sbjct: 311 ARRRLELRGEANGVTVYDDFAHHPTAILATLAALRGKVGGTARIIAVLEPRSNTMKMGIC 370

Query: 380 KSALPASLKEADQVF-CYAGGADWDVAEALAPLGCRLRVGKDFDTFVAEIVKNARTGDHI 438
            K L  SL  AD+VF     W  VAE           D T  +VK A+  GDHI
Sbjct: 371 KDDLAPSLGRADEVFLLQPAHIPWQVAEVAEACVQPAHWSGDVDTLADMVVKTAQPGDHI 430
```

```
Query: 439 LVMSNGGFGGIHTKLLDAL       457
           LVMSNGGFGGIH KLLD L
Sbjct: 431 LVMSNGGFGGIHQKLLDGL       449
```

Based on this analysis, it was predicted that these proteins from *N. meningitidis* and *N. gonorrhoeae*, and their epitopes, could be useful antigens for vaccines or diagnostics, or for raising antibodies.

ORF132-1 (26.4 kDa) was cloned in pET and pGex vectors and expressed in *E. coli*, as described above. The products of protein expression and purification were analyzed by SDS-PAGE. FIG. 20A shows the results of affinity purification of the His-fusion protein, and FIG. 20B shows the results of expression of the GST-fusion in *E. coli*. Purified His-fusion protein was used to immunise mice, whose sera were used for FACS analysis (FIG. 20C) and ELISA (positive result). These experiments confirm that ORF132 is a surface-exposed protein, and that it is a useful immunogen.

Example 103

The following partial DNA sequence was identified in *N. meningitidis* <SEQ ID 875>

```
   1 . . . CCGGGCTATT ACGGCTCGGA TGACGAATTT
         AAGCGGGCAT TCGGAGAAAA
  51 CTCGCCGACA TmCAAGAAAC ATTGCAACCG GAGCTGCGGG
         ATTTATGAAC
 101 CCGTATTGAA AAAATACGGC AAAAAGCGCG CCAACAACCA
         TTCGGTCAGC
 151 ATTAGTGCGG ACTTCGGCGA TTATTTCATG CCGTTCGCCA
         GCTATTCGCG
 201 CACACACCGT ATGCCCAACA TCCAAGAAAT GTATTTTTCC
         CAAATCGGCG
 251 ACTCCGGCGT TCACACCGCC TTAAAACCAG AGCGCGCAAA
         CACTTGGCAA
 301 TTTGGCTTCr ATACCTATAA AAAAGGATTG TTAAAACAAG
         ATGATACATT
 351 AGGATTAAAA CTGGTCGGCT ACCGCAGCCG CATCGACAAC
         TACATCCACA
 401 ACGTTTACGG GAAATGGTGG GATTTGAACG GGGATATTCC
         GAGCTGGGTC
 451 AGCAGCACCG GGCTTGCCTA CACCATCCAA CATCGCrATT
         TCAwAGACAA
 501 AGTGCATCAA nnnnnnnnnn nnnnnnnnnn nnnnTACGAT
         TATGGGCGTT
 551 TTTTCACCAA CCTTTCTTAC GCCTATCAAA AAAGCACGCA
         ACCGACCAAC
 601 TTCAGCGATG CGAGCGAATC GCCCAACAAT GCGTCCAAAG
         AAGACCAACT
 651 CAAACAAGGT TATGGGTTGA GCAGGGTTTC CGCCCTGCCG
         CGAGATTACG
 701 GACGTTTGGA AGTCGGTACG CGCTGGTTGG GCAACAAACT
         GACTTTGGGC
 751 GGCGCGATGC GCTATTTCGG CAAGAGCATC CGCGCGACGG
         CTGAAGAACG
 801 CTATATCGAC GGCACCAACG GGGGAAATAC CAGCAATTTC
         CGGCAACTGG
 851 GCAAGCGTTC CATCAAACAA ACCGAAACTC TTGCCCGCCA
         GCCTTTGATT
 901 TTwGATTTTa ACGCCGCTTA CGAGCCGAAG AAAAACCTTA
         TTTTCCGCGC
 951 CGAAGTCAAA AATCTGTTCG ACAGGCGTTA TATCGATCCG
         CTCGATGCGG
1001 GCAATGATGC GGCAAC.GAG CGTTATTACA GCTCGTTCGA
         CCCGAAAGAC
1051 AAGGACrrAG ACGTAACGTG TAATGCTGAT AAAACGTTGT
         GCaACGGCAA
1101 ATACGGCGGC ACAAGCAAAA GCGTATTGAC CAATTTTGCA
         CGCGGACGCA
1151 CCTTTTTgAT GACGATGAGC TACAAGTTTT AA
```

This corresponds to the amino acid sequence <SEQ ID 876; ORF133>:

```
  1 . . . PGYYGSDDEF KRAFGENSPT XKKHCNRSCG
        IYEPVLKHYG KKRANNHSVS
 51 ISADFGDYFM PFASYSRTHR MPNIQEMYFS QIGDSGVHTA
        LKPERANTWQ
101 FGFXTYKKGL LKQDDTLGLK LVGYRSRIDN YIHNVYGKWW
        DLNGDIPSWV
151 SSTGLAYTIQ HRXFXDKVHQ XXXXXXXXYD YGRFFTNLSY
        AYQKSTQPTN
201 FSDASESPNN ASKEDQLKQG YGLSRVSALP RDYGRLEVGT
        RWLGNKLTLG
251 GAMRYFGKSI RATAEERYID GTNGGNTSNF RQLGKRSIKQ
        TETLARQPLI
301 XDFNAAYEPK KNLIFRAEVK NLFDRRYIDP LDAGNDAAXE
        RYYSSFDPKD
351 KDXDVTCNAD KTLCNGKYGG TSKSVLTNFA RCRTFLMTMS
        YKF*
```

Further work revealed the further partial DNA sequence <SEQ ID 877>:

```
  1 GAGGCGCAGA TACAGGTTTT GGAAGATGTG CACGTCAAGG
        CGAAGCGCGT
 51 ACCGAAAGAC AAAAAAGTGT TTACCGATGC GCGTGCCGTA
        TCGACCCGTC
101 AGGATATATT CAAATCCAGC GAAAACCTCG ACAACATCGT
        ACGCAGCATC
151 CCCGGTGCGT TTACACAGCA AGATAAAAGC TCGGGCATTG
        TGTCTTTGAA
201 TATTCGCGGC GACAGCGGGT TCGGGCGGGT CAATACGATG
        GTGGACGGCA
```

```
 251 TCACGCAGAC CTTTTATTCG ACTTCTACCG ATGCGGGCAG
     GGCAGGCGGT

301 TCATCTCAAT TCGGTGCATC TGTCGACAGC AATTTTATTG
     CCGGACTGGA

351 TGTCGTCAAA GGCAGCTTCA GCGGCTCGGC AGGCATCAAC
     AGCCTTGCCG

401 GTTCGGCGAA TCTGCGGACT TTAGGCGTGG ATGACGTCGT
     TCAGGGCAAT

451 AATACCTACG GCCTGCTGCT AAAAGGTCTG ACCGGCACCA
     ATTCAACCAA

501 AGGTAATGCG ATGGCGGCGA TAGGTGCGCG CAAATGGCTG
     GAAAGCGGAG

551 CATCTGTCGG TGTGCTTTAC GGGCACAGCA GGCGCAGCGT
     GGCGCAAAAT

601 TACCGCGTGG GCGGCGGCGG GCAGCACATC GGAAATTTTG
     GCGCGGAATA

651 TTTGGAACGG CGCAAGCAGC GATATTTTGT ACAAGAGGGT
     GCTTTGAAAT

701 TCAATTCCGA CAGCGGAAAA TGGGAGCGGG ATTTACAAAG
     GCAACAGTGG

751 AAATACAAGC CGTATAAAAA TTACAACAAC CAAGAACTAC
     AaAAATACAT

801 CGAAGAGCAT GACAAAAGCT GGCGGGAAAA CCTg.CaCCG
     CAATACGACA

851 TTACCCCCAT CGATCCGTCC AGCCTGAAGC AGCAGTCGGC
     AGGCAATCTG

901 TTTAAATTGG AATACGACGG CGTATTCAAT AAATACACGG
     CGCAATTTCG

951 CGATTTAAAC ACCAAAATCG GCAGCCGCAA ATCATCAAC
     CGCAATTATC

1001 AGTTCAATTA CGGTTTGTCT TTGAACCCGT ATACCAACCT
     CAATCTGACC

1051 GCAGCCTACA ATTCGGGCAG GCAGAAATAT CCGAAAGGGT
     CGAAGTTTAC

1101 AGGCTGGGGG CTTTTAAAGG ATTTTGAAAC CTACAACAAC
     GCGAAAATCC

1151 TCGACCTCAA CAACACCGCC ACCTTCCGGC TGCCCCGCGA
     AACCGAGTTG

1201 CAAACCACTT TGGGCTTCAA TTATTTCCAC AACGAATACG
     GCAAAAACCG

1251 CTTTCCTGAA GAATTGGGGC TGTTTTTCGA CGGTCCTGAT
     CAGGACAACG

1301 GGCTTTATTC CTATTTGGGG CGGTTTAAGG GCGATAAAGG
     GCTGCTGCCC

1351 CAAAAATCAA CCATTGTCCA ACCGGCCGGC AGCCAATATT
     TCAACACGTT

1401 CTACTTCGAT GCCGCGCTCA AAAAGACAT TTACCGCTTA
     AACTACAGCA

1451 CCAATACCGT CGGCTACCGT TTCGGCGGCG AATATACGGG
     CTATTACGGC

1501 TCGGATGACG AATTTAAGCG GGCATTCGGA GAAAACTCGC
     CGACATACAA

1551 GAAACATTGC AACCGGAGCT GCGGGATTTA TGAACCCGTA
     TTGAAAAAAT

1601 ACGGCAAAAA GCGCGCCAAC AACCATTCGG TCAGCATTAG
     TGCGGACTTC

1651 GGCGATTATT TCATGCCGTT CGCCAGCTAT TCGCGCACAC
     ACCGTATGCC

1701 CAACATCCAA GAAATGTATT TTTCCCAAAT CGGCGACTCC
     GGCGTTCACA

1751 CCGCCTTAAA ACCAGAGCGC GCAAACACTT GGCAATTTGG
     CTTCAATACC

1801 TATAAAAAAG GATTGTTAAA ACAAGATGAT ACATTAGGAT
     TAAAACTGGT

1851 CGGCTACCGC AGCCGCATCG ACAACTACAT CCACAACGTT
     TACGGGAAAT

1901 GGTGGGATTT GAACGGGGAT ATTCCGAGCT GGGTCAGCAG
     CACCGGGCTT

1951 GCCTACACCA TCCAACATCG CAATTTCAAA GACAAAGTGC
     ACAAACACGG

2001 TTTTGAGTTG GAGCTGAATT ACGATTATGG GCGTTTTTTC
     ACCAACCTTT

2051 CTTACGCCTA TCAAAAAAGC ACGCAACCGA CCAACTTCAG
     CGATGCGAGC

2101 GAATCGCCCA ACAATGCGTC CAAAGAAGAC CAACTCAAAC
     AAGGTTATGG

2151 GTTGAGCAGG GTTTCCGCCC TGCCGCGAGA TTACGGACGT
     TTGGAAGTCG

2201 GTACGCGCTG GTTGGGCAAC AAACTGACTT TGGGCGGCGC
     GATGCGCTAT

2251 TTCGGCAAGA GCATCCGCGC GACGGCTGAA GAACGCTATA
     TCGACGGCAC

2301 CAACGGGGGA AATACCAGCA ATTTCCGGCA ACTGGGCAAG
     CGTTCCATCA

2351 AACAAACCGA AACTCTTGCC CGCCAGCCTT TGATTTTTGA
     TTTTTACGCC

2401 GCTTACGAGC CGAAGAAAAA CCTTATTTTC CGCGCCGAAG
     TCAAAAATCT

2451 GTTCGACAGG CGTTATATCG ATCCGCTCGA TGCGGGCAAT
     GATGCGGCAA

2501 CGCAGCGTTA TTACAGCTCG TTCGACCCGA AAGACAAGGA
     CGAAGACGTA

2551 ACGTGTAATG CTGATAAAAC GTTGTGCAAC GGCAAATACG
     GCGGCACAAG

2601 CAAAAGCGTA TTGACCAATT TTGCACGCGG ACGCACCTTT
     TTGATGACGA

2651 TGAGCTACAA GTTTTAA
```

This corresponds to the amino acid sequence <SEQ ID 878; ORF133-1>:

```
  1 EAQIQVLEDV HVKAKRVPKD KKVFTDARAV STRQDIFKSS
    ENLDNIVRSI

51 PGAFTQQDKS SGIVSLNIRG DSGFGRVNTM VDGITQTFYS
    TSTDAGRAGG

101 SSQFGASVDS NFIAGLDVVK GSFSGSAGIN SLAGSANLRT
    LGVDDVVQGN

151 NTYGLLLKGL TGTNSTKGNA MAAIGARKWL ESGASVGVLY
    GHSRRSVAQN

201 YRVGGGGQHI GWFGAEYLER RKQRYFVQEG ALKFNSDSGK
    WERDLQRQQW

251 KYKPYKNYNN QELQKYIEEH DKSWRENLXP QYDITPIDPS
    SLKQQSAGNL

301 EKLEYDGVFN KYTAQFRDLN TKIGSRKIIN RNYQFNYGLS
    LNPYTNLNLT

351 AAYNSGRQKY PKGSKFTGWG LLKDFETYNN AKILDLNNTA
    TFRLPRETEL

401 QTTLGFNYFH NEYGKNRFPE ELGLFFDGPD QDNGLYSYLG
    RFKGDKGLLP

451 QKSTIVQPAG SQYFNTFYFD AALKKDIYRL NYSTNTVGYR
    FGGEYTGYYG

501 SDDEFKRAFG ENSPTYKKHC NRSCGIYEPV LKKYGKKRAN
    NHSVSISADF

551 GDYFMPFASY SRTHRMPNIQ EMYFSQIGDS GVHTALKPER
    ANTWQFGFNT

601 YKKGLLKQDD TLGLKLVGYR SRIDNYIHNV YGKWWDLNGD
    IPSWVSSTGL

651 AYTIQHRNFK DKVHKHGFEL ELNYDYGRFF TNLSYAYQKS
    TQPTNFSDAS

701 ESPNNASKED QLKQGYGLSR VSALPRDYGR LEVGTRWLGN
    KLTLGGAMRY

751 FGKSIRATAE ERYIDGTNGG NTSNFRQLGK RSIKQTETLA
    RQPLIFDEYA

801 AYEPKKNLIF RAEVKNLFDR RYIDPLDAGN DAATQRYYSS
    FDPKDKDEDV

851 TCNADKTLCN GKYGGTSKSV LTNFARGRTF LMTMSYKF*
```

Computer analysis of this amino acid sequence gave the following results:

Homology with the Probable TonB-Dependent Receptor HI121 of *H. influenzae* (Accession Number U32801)

ORF133 and HI121 show 57% aa identity in 363aa overlap:

```
Orf133:  31 IYEPVLKKYGKKRANNHSVSISADFGDYFMPFASYSRTHRMPNIQEMYFSQIGDSGVHTA   90
             I EP+L K G K+A NHS ++SA+  DYFMPF +YSRTHRMPNIQEM+FSQ+ ++GV+TA
HI121:  563 INEPILHKSGHKKAFNHSATLSAELSDYFMPFFTYSRTHRNPNIQEMFFSQVSNAGVNTA  622

Orf133:  91 LKPERANTWQFGFXTYKKGLLKQDDTLGLKLVGYRSRIDNYIHNVYGKWWDLNGDIPSWV  150
             LKPE+++T+Q GF TYKKGL  QDD LG+KLVGYRS I NYIHNVYG WW      +P+W
HI121:  623 LKPEQSDTYQLGFNTYKKGLFTQDDVLGVKLVGYRSFIKNYIHNVYGVWW--RDGMFTWA  680

Orf133: 151 SSTGLAYTIQHRXFXDKVHXXXXXXXXXXYDYGRFFTNLSYAYQKSTQPTNFSDASESPNN  210
              S  G  YTI H+ +      V          YD GRFF N+SYAYQ++ QPTN++DAS  PNN
HI121:  681 ESNGFKYTIAHQNYKPIVKKSGVELEINYDMGRFFANVSYAYQRTNQPTNYADASPRPNN  740

Orf133: 211 ASKEDQLKQGYGLSRVSALPRDYGRLEVGTRWLGNKLTLGGAMRYFGKSIRATAEERYID  270
             AS+ED LKQGYGLSRVS LP+DYGRLE+GTRW   KLTLC A RY+GKS RAT RE YI+
HI121:  741 ASQEDILKQGYGLSRVSMLPKDYGRLELGTRWFDQKLTLGLAARYYGKSKRATIEEEYIN  800

Orf133: 271 GTNGGNTSNFRQLGKRSIKQTETLARQPLIXDFNAAYEPKKNLIFRAEVKNLFDRRYIDP  330
             G+        + R+    ++K+TE +  +QP+I D + +YEP K+LI +AEV+NL D+RY+DP
HI121:  801 GSR-FKKNTLRRENYYAVKKTEDIKKQPIILDLHVSYEPIKDLIIKAEVQNLLDKRYVDP  859

Orf133: 331 LDAGNDAAXERYYSSFDPKDKDXDVTCNADKTLCNGKYGGTSKSVLTNFARGRTFLMTMS  390
             LDAGNDAA +RYYSS     +  + C D + C    GG+ K+VL NFARGRT++++++
HI121:  860 LDAGNDAASQRYYSSL-----NNSIECAQDSSAC----GGSDKTVLYNFARGRTYILSLN  910

Orf133: 391 YKF                                                          393
             YKF
HI121:  911 YKF                                                          913
```

Homology with a Predicted ORF from *N. meningitidis* (Strain A)

ORF133 shows 90.8% identity over a 392aa overlap with an ORF (ORF133a) from strain A of *N. meningitidis*:

```
                                      10        20        30
orf133.pep                    PGYYGSDDEFKRAFGENSPTXKKHCNRSCGI
                                 ||| |||||||||||||||  |||:||||
orf133a    FYFDAALKKDIYRLNYSTNTVGYRFGGXYTGYYXSDDEFKRAFGENSPTYXKHCNQSCGI
           450       460       470       480       490       500
                   40        50        60        70        80        90
orf133.pep YEPVLKKYGKKRANNHSVSISADFGDYFMPFASYSRTHRMPNIQEMYFSQIGDSGVHTAL
           ||||||||||||||||||||||||||||||||||||||||||||||||||||||||||||
orf133a    YEPVLKKYGKKRANNHSVSISADFGDYFMPFASYSRTHRMPNIQEMYFSQIGDSGVHTAL
           510       520       530       540       550       560
                  100       110       120       130       140       150
orf133.pep KPERANTWQFGFXTYKKGLLKQDDTLGLKLVGYRSRIDNYIHNVYGKWWDLNGDIPSWVS
           |||||||||||| |||||||||||| ||||||||||| :|||||||||||||:|||||||
orf133a    KPERANTWQFGFNTYKKGLLKQDDILGLKLVGYRSRIDXYIHNVYGKWWDLNGNIPSWVS
           570       580       590       600       610       620
                  160       170       180       190       200       210
orf133.pep STGLAYTIQHRXFXDKVHQXXXXXXXXXYDYGRFFTNLSYAYQKSTQPTNFSDASESPNNA
           |||||||||||| | ||||:         ||| |||||||||||||||||||||||||||
orf133a    STGLAYTIQHRNFKDKVHKHGFELELNYDYXRFFTNLSYAYQKSTQPTNFSDASESPNNA
           630       640       650       660       670       680
                  220       230       240       250       260       270
orf133.pep SKEDQLKQGYGLSRVSALPRDYGRLEVGTRWLGNKLTLGGAMRYFGKSIRATAEERYIDG
           ||||||||||||||||||||||||||||||||||||||||||||||||||||||||||| 
orf133a    SKEDQLKQGYGLSRVSALPRDYGRLEVGTRWLGNKLTLGGAMRYFGKSIRATAEERYIDX
           690       700       710       720       730       740
                  280       290       300       310       320       330
orf133.pep TNGGNTSNFRQLGKRSIKQTETLARQPLIXDFNAAYEPKKNLIFRAEVKNLFDRRYIDPL
           |||  |||||||||||||:|||||||||| ||  |||||| |||||||||||||||||||
orf133a    TNGXXTSNFRQLGKRSIXQTETLARQPLIFDXYAAYEPKKXLIFRAEVKNLFDRRYIDPL
           750       760       770       780       790       800
                  340       350       360       370       380       390
orf133.pep DAGNDAAXERYYSSFDPKDKDXDVTCNADKTLCNGKYGGTSKSVLTNFARGRTFLMTMSY
           ||||||| ::|||||||||||:||| :||:||||||||||||||||||||| :|| ||||
orf133a    DAGNDAATQRYYSSFDPKDKDEEVTCNDDNTLCNGKYGGTSKSVLTNFARGXTFLITMSY
           810       820       830       840       850       860
orf133.pep KFX
           |||
orf133a    KFX
           870
```

A partial ORF133a nucleotide sequence <SEQ ID 879> is:

```
  1  AAAGACAAAA AAGTGTTTAC CGATGCGCGT GCCGTATCGA
     CCCGTCAGGA

51  TATATTCAAA TCCANCGAAA ACCTCGACAA CATCGTACGC
     ANCATCCCCG

101  GTGCGTTTAC ACANCAANAT AAAAGCTCGG GCNTTGTGTC
     TTTGAATATT

151  CGCNGCGACA GCGGGTTCGG GCGGGTCAAT ACNATGGTNG
     ACGGCATCAC

201  NCANACCTTT TATTCGACTT CTACCGATGC GGGCAGGGCA
     GGCGGTTCAT

251  CTCAATTCGG TGCATCTGTC GACAGCAATT TTATNGCCGG
     ACTGGATGTC

301  GTCAAAGGCA GCTTCAGCGG CTCGGCAGGC ATCAACAGCC
     TTGCCGGTTC

351  GGCGAATCTG CGGACTTTAN GCGTGGATGA TGTCGTTCAG
     GGCAATANTA

401  CNTACGGCCT GCTGCTAAAA GGTCTGACCG GCACCAATTC
     AACCAAAGGT

451  AATGCGATGG CGGCGATAGG TGCGCGCAAA TGGCTGGAAA
     GCGGAGCATC

501  TGTCGGTGTG CTTTACGGGC ACAGCAGGCG CAGCGTGGCG
     CAAAATTACC

551  GCGTGGGCGG CGGCGGGCAG CACATCGGAA ATTTTGGCGC
     GGAATATCTG

601  GAACGACGCA AGCAACGATA TTTTGAGCAA GAAGGCGGGT
     TGAAATTCAA

651  TTCCAACAGC GGAAAATGGG AGCGGGATTT CCAAAAGTCG
     TACTGGAAAA

701  CCAAGTGGTA TCAAAAATAC GATGCCCCCC AAGAACTGCA
     AAAATACATC

751  GAAGGTCATG ATAAAAGCTG GCGGGAAAAC CTGGCGCCGC
     AATACGACAT

801  CACCCCCATC GATCCGTCCA GCCTGAAGCN GCAGTCGGCA
     GGCAACCTGT

851  TTAAATTGGA ATACGACGGC GTATTCAATA AATACACGGC
     GCAATTTCGC
```

```
 901 GATTTAAACA CCAAAATCGG CAGCCGCAAA ATCATCAACC
      GCAATTATCA

951 ATTCAATTAC GGTTTGTCTT TGAACCCGTA TACCAACCTC
      AATCTGACCG

1001 CAGCCTACAA TTCGGGCAGG CAGAAATATC CGAAAGGGTC
      GAAGTTTACA

1051 GGCTGGGGGC TTTTNAAAGA TTTTGAAACC TACAACAACG
      CAAAAATCCT

1101 CGACCTCANC AACACCTCCA CCTTCCGGCT GCCCCGTGAA
      ACCGAGTTGC

1151 AAACCACTTT GGGCTTCAAT TATTTCCACA ACGAATACGG
      CAAAAACCGC

1201 TTTCCTGAAG AATTGGGGCT GTTTTTCGAC GGTCCGGATC
      ANGACAACGG

1251 GCTTTATTCC TATTTGGGGC GGTTTAAGGG CGATAAAGGG
      CTGCTGCCCC

1301 AAAAATCAAC CATTGTCCAA CCGGCCGGCA GCCAATATTT
      CAACACGTTC

1351 TACTTCGATG CCGCGCTCAA AAAAGACATT TACCGCTTAA
      ACTACAGCAC

1401 CAATACCGTC GGCTACCGTT TCGGCGGCNA ATATACGGGC
      TATTACNGCT

1451 CGGATGACGA ATTTAAGCGG GCATTCGGAG AAAACTCGCC
      GACATACANG

1501 AAACATTGCA ACCAGAGCTG CGGAATTTAT GAACCCGTAT
      TGAAAAAATA

1551 CGGCAAAAAG CGCGCCAACA ACCATTCGGT CAGCATTAGT
      GCGGACTTCG

1601 GCGATTATTT CATGCCGTTC GCCAGCTATT CGCGCACACA
      CCGTATGCCC

1651 AACATCCAAG AAATGTATTT TTCCCAAATC GGCGACTCCG
      GCGTTCACAC

1701 CGCCTTAAAA CCAGAGCGCG CAAACACTTG GCAATTTGGC
      TTCAATACCT

1751 ATAAAAAAGG ATTGTTAAAA CAAGATGATA TATTAGGATT
      AAAACTGGTC

1801 GGCTACCGCA GCCGCATCGA CNACTACATC CACAACGTTT
      ACGGGAAATG

1851 GTGGGATTTG AACGGGAATA TTCCGAGCTG GGTCAGCAGC
      ACCGGGCTTG

1901 CCTACACCAT CCAACACCGC AATTTCAAAG ACAAAGTGCA
      CAAACACGGT

1951 TTTGAGTTGG AGCTGAATTA CGATTATNGG CGTTTTTTCA
      CCAACCTTTC

2001 TTACGCCTAT CAAAAAAGCA CGCAACCGAC CAACTTCAGC
      GATGCGAGCG

2051 AATCGCCCAA CAATGCGTCC AAAGAAGACC AACTCAAACA
      AGGTTATGGG

2101 TTGAGCAGGG TTTCCGCCCT GCCGCGAGAT TACGGACGTT
      TGGAAGTCGG

2151 TACGCGCTGG TTGGGCAACA AACTGACTTT GGGCGGCGCG
      ATGCGCTATT

2201 TCGGCAAGAG CATCCGCGCG ACGGCTGAAG AACGCTATAT
      CGACGNCACC

2251 AATGGGGNAN NTACCAGCAA TTTCCGGCAA CTGGGCAAGC
      GTTCCATCAN

2301 ACAAACCGAA ACCCTTGCCC GCCAGCCTTT GATTTTTGAT
      TTNTACGCCG

2351 CTTACGAGCC GAAGAAAAAN CTTATTTTCC GCGCCGAAGT
      CAAAAATCTG

2401 TTCGACAGGC GTTATATCGA TCCGCTCGAT GCGGGCAATG
      ATGCGGCAAC

2451 GCAGCGTTAT TACAGTTCGT TCGACCCGAA AGACAAGGAC
      GAAGAAGTAA

2501 CGTGTAATGA TGATAACACG TTATGCAACG GCAAATACGG
      CGGCACAAGC

2551 AAAAGCGTAT TGACCAATTT TGCACGCGGA CNCACCTTTT
      TGATAACGAT

2601 GAGCTACAAG TTTTAA
```

This encodes a protein having (partial) amino acid sequence <SEQ ID 880>:

```
  1 KDKKVFTDAR AVSTRQDIFK SXENLDNIVR XIPGAFTXQX
    KSSGXVSLNI

51 RXDSGFGRVN TMVDGITXTF YSTSTDAGRA GGSSQFGASV
    DSNFXAGLDV

101 VKGSFSGSAG INSLAGSANL RTLXVDDVVQ GNXTYGLLLK
    GLTGTNSTKG

151 NAMAAIGARK WLESGASVGV LYGHSRRSVA QNYRVGGGGQ
    HIGNFGAEYL

201 ERRKQRYFEQ EGGLKFNSNS GKWERDFQKS YWKTKWYQKY
    DAPQELQKYI

251 EGHDKSWREN LAPQYDITPI DPSSLKXQSA GNLFKLEYDG
    VFNKYTAQFR

301 DLNTKIGSRK IINRNYQFNY GLSLNPYTNL NLTAAYNSGR
    QKYPKGSKFT

351 GWGLXKDFET YNNAKILDLX NTSTFRLPRE TELQTTLGFN
    YFHNEYGKNR

401 FPEELGLFFD GPDXDNGLYS YLGRFKGDKG LLPQKSTIVQ
    PAGSQYFNTF

451 YFDAALKKDI YRLNYSTNTV GYRFGGXYTG YYXSDDEFKR
    AFGENSPTYX

501 KHCNQSCCIY EPVLKKYGKK RANNHSVSIS ADFGDYFMPF
    ASYSRTHRMP

551 NIQEMYFSQI GDSGVHTALK PERANTWQFG FNTYKKGLLK
    QDDILGLKLV

601 GYRSRIDXYI HNVYGKWWDL NGNIPSWVSS TGLAYTIQHR
    NFKDKVHKHG

651 FELELNYDYX RFFTNLSYAY QKSTQPTNFS DASESPNNAS
    KEDQLKQGYG
```

-continued

```
701 LSRVSALPRD YGRLEVGTRW LGNKLTLGGA MRYFGKSIRA
    TAEERYIDXT

751 NGXXTSNFRQ LGKRSIXQTE TLARQPLIFD XYAAYEPKKX
    LIFRAEVKNL
```

-continued

```
801 FDRRYIDPLD AGNDAATQRY YSSFDPKDKD EEVTCNDDNT
    LCNGKYGGTS

851 KSVLTNFARG XTFLITMSYK F*
```

ORF133a and ORF133-1 show 94.3% identity in 871 aa overlap:

```
                        10         20         30         40
orf133a.pep             KDKKVFTDARAVSTRQDIFKSXENLDNIVRXIPGAFTXQXKS
                        ||||||||||||||||||||||| ||||||||||| |||| | ||
orf133-1    EAQIQVLEDVHVKAKRVPKDKKVFTDARAVSTRQDIFKSSENLDNIVRSIPGAFTQQDKS
            10         20         30         40         50         60

50         60         70         80         90        100
orf133a.pep SGXVSLNIRXDSGFGRVNTMVDGITXTFYSTSTDAGRAGGSSQFGASVDSNFXAGLDVVK
            || |||||| |||||||||||||| ||||||||||||||||||||||||||| ||||||
orf133-1    SGIVSLNIRGDSGFGRVNTMVDGITQTFYSTSTDAGRAGGSSQFGASVDSNFIAGLDVVK
            70         80         90        100        110        120

110        120        130        140        150        160
orf133a.pep GSFSGSAGINSLAGSANLRTLXVDDVVQGNXTYGLLLKGLTGTNSTKGNAMAAIGARKWL
            |||||||||||||||||||||| ||||||| |||||||||||||||||||||||||||||
orf133-1    GSFSGSAGINSLAGSANLRTLGVDDVVQGNNTYGLLLKGLTGTNSTKGNAMAAIGARKWL
           130        140        150        160        170        180

170        180        190        200        210        220
orf133a.pep ESGASVGVLYGHSRRSVAQNYRVGGGGQHIGNFGAEYLERRKQRYFEQEGGLKFNSNSGK
            |||||||||||||||||||||||||||||||||||||||||||||| :|||| :|||
orf133-1    ESGASVGVLYGHSRRSVAQNYRVGGGGQHIGNFGAEYLERRKQRYFVQEGALKFNSDSGK
           190        200        210        220        230        240

230        240        250        260        270        280
orf133a.pep WERDFQKSYWKTKWYQKYDAPQELQKYIEGHDKSWRENLAPQYDITPIDPSSLKXQSAGN
            ||||:|::: || |::|:  |||||||| ||||||||||| |||||||||||||| ||||
orf133-1    WERDLQRQQWKYKPYKNYN-QELQKYIEEHDKSWRENLXPQYDITPIDPSSLKQQSAGN
           250        260        270        280        290

290        300        310        320        330        340
orf133a.pep LFKLEYDGVFNKYTAQFRDLNTKIGSRKIINRNYQFNYGLSLNPYTNLNLTAAYNSGRQK
            ||||||||||||||||||||||||||||||||||||||||||||||||||||||||||||
orf133-1    LFKLEYDGVFNKYTAQFRDLNTKIGSRKIINRNYQFNYGLSLNPYTNLNLTAAYNSGRQK
           300        310        320        330        340        350

350        360        370        380        390        400
orf133a.pep YPKGSKFTGWGLXKDFETYNNAKILDLXNTSTFRLPRETELQTTLGFNYFHNEYGKNRFP
            ||||||||||||| ||||||||||||| | :|||||||||||||||||||||||||||||
orf133-1    YPKGSKFTGWGLLKDFETYNNAKILDLNNTATFRLPRETELQTTLGFNYFHNEYGKNRFP
           360        370        380        390        400        410

410        420        430        440        450        460
orf133a.pep EELGLFFDGPDXDNGLYSYLGRFKGDKGLLPQKSTIVQPAGSQYFNTFYFDAALKKDIYR
            ||||||||||| |||||||||||||||||||||||||||||||||||||||||||||||
orf133-1    EELGLFFDGPDQDNGLYSYLGRFKGDKGLLPQKSTIVQPAGSQYFNTFYFDAALKKDIYR
           420        430        440        450        460        470

470        480        490        500        510        520
orf133a.pep LNYSTNTVGYRFGGXYTGYYXSDDEFKRAFGENSPTYXKHCNQSCGIYEPVLKKYGKKRA
            |||||||||||||| ||||| ||||||||||||||| ||||:|||||||||||||||||
orf133-1    LNYSTNTVGYRFGGEYTGYYGSDDEFKRAFGENSPTYKKHCNRSCGIYEPVLKKYGKKRA
           480        490        500        510        520        530

530        540        550        560        570        580
orf133a.pep NNHSVSISADFGDYFMPPFASYSRTHRMPNIQEMYFSQIGDSGVHTALKPERANTWQFGFN
            ||||||||||||||||||||||||||||||||||||||||||||||||||||||||||||
orf133-1    NNHSVSISADFGDYFMPPFASYSRTHRMPNIQEMYFSQIGDSGVHTALKPERANTWQFGFN
           540        550        560        570        580        590

590        600        610        620        630        640
orf133a.pep TYKKGLLKQDDILGLKLVGYRSRIDXYIHNVYGKWWDLNGNIPSWVSSTGLAYTIQHRNF
            |||||||||||| |||||||||||| :|||||||||||| ||||||||||||||||||
orf133-1    TYKKGLLKQDDTLGLKLVGYRSRIDNYIHNVYGKWWDLNGDIPSWVSSTGLAYTIQHRNF
           600        610        620        630        640        650

650        660        670        680        690        700
orf133a.pep KDKVHKHGFELELNYDXRFFTNLSYAYQKSTQPTNFSDASESPNNASKEDQLKQGYGLS
            ||||||||||||||||| |||||||||||||||||||||||||||||||||||||||||
orf133-1    KDKVHKHGFELELNYDGRFFTNLSYAYQKSTQPTNFSDASESPNNASKEDQLKQGYGLS
           660        670        680        690        700        710
```

```
                  -continued
            710       720       730       740       750       760
orf133a.pep RVSALPRDYGRLEVGTRWLGNKLTLGGAMRYFGKSIRATAEERYIDXTNGXXTSNFRQLG
            ||||||||||||||||||||||||||||||||||||||||||||||   ||||||||
orf133-1    RVSALPRDYGRLEVGTRWLGNKLTLGGAMRYFGKSIRATAEERYIDGTNGGNTSNFRQLG
            720       730       740       750       760       770
                  770       780       790       800       810       820
orf133a.pep KRSIXQTETLARQPLIFDXYAAYEPKKXLIFRAEVKNLFDRRYIDPLDAGNDAATQRYYS
            ||||  ||||||||||||| |||||||| |||||||||||||||||||||||||||||
orf133-1    KRSIKQTETLARQPLIFDFYAAYEPKKNLIFRAEVKNLFDRRYIDPLDAGNDAATQRYYS
            780       790       800       810       820       830
                  830       840       850       860       870
orf133a.pep SFDPKDKDEEVTCNDDNTLCNGKYGGTSKSVLTNFARGXTFLITMSYKFX
            ||||||||:||| | :|||||||||||||||||||||| |||:||||||
orf133-1    SFDPKDKDEDVTCNADKTLCNGKYGGTSKSVLTNFARGRTFLMTMSYKFX
            840       850       860       870       880
```

Homology with a Predicted ORF from *N. gonorrhoeae*
ORF133 shows 92.3% identity over 392 aa overlap with a
predicted ORF (ORF133ng) from *N. gonorrhoeae*:

```
orf133.pep                             PGYYGSDDEFKRAFGENSPTXKKHCNRSCGI    31
                                       ||||||::||||||||||: |:||:  |||:
orf133ng    FYFDAALKKDIYRLNYSTNAINYRFGGEYTGYYGSENEFKRAFGENSPAYKEHCDPSCGL   560
orf133.pep  YEPVLKKYGKKRANNHSVSISADFGDYFMPFASYSRTHRMPNIQEMYFSQIGDSGVHTAL    91
            |||||||||||||||||||||||||||||| |||||||||||||||||||||||||||||
orf133ng    YEPVLKKYGKKRANNHSVSISADFGDYFMPFAGYSRTHRMPNIQEMYFSQIGDSGVHTAL   620
orf133.pep  KPERANTWQFGFXTYKKGLLKQDDTLGLKLVGYRSRIDNYIHNVYGKWWDLNGDIPSWVS   151
            ||||||||||||  |||||||||||| |||||||||||||||||||||||||||||||:
orf133ng    KPERANTWQFGFNTYKKGLLKQDDILGLKLVGYRSRIDNYIHNVYGKWWDLNGDIPSWVG   680
orf133.pep  STGLAYTIQHRXFXDKVHQXXXXXXXXYDYGRFFTNLSYAYQKSTQPTNFSDASESPNNA   211
            |||||||:|| || ||||:       ||||||||||||||||||||||||||||||||||
orf133ng    STGLAYTIRHRNFKDKVHKHGFELELNYDYGRFFTNLSYAYQKSTQPTNFSDASESPNNA   740
orf133.pep  SKEDQLKQGYGLSRVSALPRDYGRLEVGTRWLGNKLTLGGAMRYFGKSIRATAEERYIDG   271
            ||||||||||||||||||||||||||||||||||||||||||||||||||||||||||||
orf133ng    SKEDQLKQGYGLSRVSALPRDYGRLEVGTRWLGNKLTLGGAMRYFGKSIRATAEERYIDG   800
orf133.pep  TNGGNTSNFRQLGKRSIKQTETLARQPLIXDFNAAYEPKKNLIFRAEVKNLFDRRYIDPL   331
            |||||||| ||||||||||||||||||| ||  |||||||||||||||||||||||||||
orf133ng    TNGGNTSNVRQLGKRSIKQTETLARQPLIFDFYAAYEPKKNLIFRAEVKNLFDRRYIDPL   860
orf133.pep  DAGNDAAXERYYSSFDPKDKDXDVTCNADKTLCNGKYGGTSKSVLTNFARGRTFLMTMSY   391
            |||||||:::|||||||||||:||||||||||||||||||||||||||||||||||||||
orf133ng    DAGNDAATQRYYSSFDPKDKDEDVTCNADKTLCNGKYGGTSKSVLTNFARGRTFLMTMSY   920
orf133.pep  KF   393
            ||
orf133ng    KF   922
```

The complete length ORF133ng nucleotide sequence <SEQ ID 881> is predicted to encode a protein having amino acid sequence <SEQ ID 882>:

```
  1 MRSSFRLKPI CFYLMGVMLY HHSYAEDAGR AGSEAQIQVL
    EDVHVKAKRV
 51 PKDKKVFTDA RAVSTRQDVF KSGENLDNIV RSIPGAFTQQ
    DKSSGIVSLN
101 IRGDSGFGRV NTMVDGITQT FYSTSTDAGR AGGSSQFGAS
    VDSNFIAGLD
151 VVKGSFSGSA GINSLAGSAN LRTLGVDDVV QGNNTYGLLL
    KGLTGTNSTK
201 GNAMAAIGAR KWLESGASVG VLYGHSRRGV AQNYRVGGGG
    QHIGNFGEEY
251 LERRKQQYFV QEGGLKFNAG SGKWERDLQR QYWKTKWYKK
    YEDFQELQKY
301 IEEHDKSWRE NLAPQYDITP IDPSGLKQQS AGNLLNLEYD
    GVFNKYTAQF
351 RDLNTRIGSR KIINRNYQFN YGLSLNPYTN LNLTAAYNSG
    RQKYPKGAKF
401 TGWGLLKDFE TYNNAKILDL NNTATFRLPR ETELQTTLGF
    NYFHNEYGKN
451 RFPEELGLFF DGPDQDNGLY SYLGRFKGDK GLLPQKSTIV
    QPAGSQYFNT
501 FYFDAALKKD IYRLNYSTNA INYRFGGEYT GYYGSENEFK
    RAFGENSPAY
551 KEHCDPSCGL YEPVLKKYGK KRANNHSVSI SADFGDYFMP
    FAGYSRTHRM
601 PNIQEMYFSQ IGDSGVHTAL KPERANTWQF GFNTYKKGLL
    KQDDILGLKL
```

-continued

```
651 VGYRSRIDNY IHNVYGKWWD LNGDIPSWVG STGLAYTIRH
    RNFKDKVHKH

701 GFELELNYDY GRFFTNLSYA YQKSTQPTNF SDASESPNNA
    SKKDQLKQGY

751 GLSRVSALPR DYGRLEVGTR WLGNKLTLGG AMRYFGKSIR
    ATAEERYIDG

801 TNGGNTSNVR QLGKRSIKQT ETLARQPLIF DFYAAYEPKK
    NLIFRAEVKN

851 LFDRRYIDPL DAGNDAATQR YYSSFDPKDK DEDVTCNADK
    TLCNGKYGGT

901 SKSVLTNFAR GRTFLMTMSY KF*
```

A variant was also identified, being encoded by the gonococcal DNA sequence <SEQ ID 883>:

```
  1 ATGAGATCTT CTTTCCGGTT GAAGCCGATT TGTTTTTATC
    TTATGGGTGT

51 TATGCTATAT CATCATAGTT ATGCCGAAGA TGCAGGGCGC
    GCGGGCAGCG

101 AGGCGCAGAT ACAGGTTTTG GAAGATGTGC ACGTCAAGGC
    GAAGCGCGTA

151 CCGAAAGACA AAAAGTGTT TACCGATGCG CGTGCCGTAT
    CGACCCGTca 201 gGATGTGTTC AAATCCGGCG AAAACCTCGA CAACATCGTA
    CGCAGCATAC

251 CCGGTGCGTT TACACAGCAA GATAAAAGCT CGGGCATTGT
    GTCTTTGAAT

301 ATTCGCGGCG ACAGCGGGTT CGGGCGGGTC AATACGATGG
    TGGACGGCAT

351 CACGCAGACC TTTTATTCGA CTTCTACCGA TGCGGGCAGG
    GCAGGCGGTT

401 CATCTCAATT CGGTGCATCT GTCGACAGCA ATTTTATTGC
    CGGACTGGAT

451 GTCGTCAAAG CCAGCTTCAG CGGCTCGGCA GGCATCAACA
    GCCTTGCCGG

501 TTCGGCGAAT CTGCGGACTT TAGGCGTGGA TGACGTCGTT
    CAGGGCAATA

551 ATACCTACGG CCTGCTGCTA AAAGGTCTGA CCGGCACCAA
    TTCAACCAAA

601 GGTAATGCGA TGGCGGCGAT AGGTGCGCGC AAATGGCTGG
    AAAGCGGAGC

651 GTCTGTCGGT GTGCTTTACG GCACAGCAG GCGCGGCGTG
    GCGCAAAATT

701 ACCGCGTGGG CGGCGGCGGG CAGCACATCG GAAATTTTGG
    TGAAGAATAT

751 CTGGAACGGC GCAAACAGCA ATATTTTGTA CAAGAGGGTG
    GTTTGAAATT

801 CAATGCCGGC AGCGGAAAAT GGGAACGGGA TTTGCAAAGG
    CAATACTGGA

851 AAACAAAGTG GTATAAAAAA TACGAAGACC CCCAAGAACT
    GCAAAAATAC

901 ATCGAAGAGC ATGATAAAAG CTGGCGGGAA AACCTGGCGC
    CGCAATACGA
```

-continued

```
951 CATCACCCCC ATCGATCCGT CCGGCCTGAA GCAGCAGTCG
    GCAGGCAATC

1001 TGTTTAAATT GGAATACGAC GGCGTATTCA ATAAATACAC
     GGCGCAATTT

1051 CGCGATTTAA ACACCAGAAT CGGCAGCCGC AAAATCATCA
     ACCGCAATTA

1101 TCAATTCAAT TACGGTTTGT CTTTGAACCC GTATACCAAC
     CTCAATCTGA

1151 CCGCAGCCTA CAATTCGGGC AGGCAGAAAT ATCCGAAAGG
     GGCGAAGTTT

1201 ACAGGCTGGG GGCTTTTAAA AGATTTTGAA ACCTACAACA
     ACGCGAAAAT

1251 CCTCGACCTC AACAACACCG CCACCTTCCG GCTGCCCCGC
     GAAACCGAGT

1301 TGCAAACCAC TTTGGGCTTC AATTATTTCC ACAACGAATA
     CGGCAAAAAC

1351 CGCTTTCCTG AAGAATTGGG GCTGTTTTTC GACGGTCCTG
     ATCAGGACAA

1401 CGGGCTTTAT TCCTATTTGG GGCGGTTTAA GGGCGATAAA
     GGGCTGTTGC

1451 CTCAAAAATC AACCATTGTC CAACCGGCCG GCAGCCAATA
     TTTCAACACG

1501 TTCTACTTCG ATGCCGCGCT CAAAAAAGAC ATTTACCGCT
     TAAACTACAG

1551 CACCAATGCA ATCAACTACC GTTTCGGCGG CGAATATACG
     GGCTATTACG

1601 GCTCGGAAAA CGAATTTAAG CGGGCATTCG GAGAAAACTC
     GCCGGCATAC

1651 AAGGAACATT GCGACCCGAG CTGCGGGCTT TATGAACCCG
     TATTGAAAAA

1701 ATACGGCAAA AAGCGCGCCA ACAACCATTC GGTCAGCATT
     AGTGCGGACT

1751 TCGGCGATTA TTTCATGCCG TTCGCCGGCT ATTCGCGCAC
     ACACCGTATG

1801 CCCAACATCC AAGAAATGTA TTTTTCCCAA ATCGGCGACT
     CCGGCGTTCA

1851 CACCGCCTTA AAACCAGAGC GCGCAAACAC TTGGCAATTT
     GGCTTCAATA

1901 CCTATAAAAA AGGATTGTTA AAACAAGATG ATATATTAGG
     ATTGAAACTG

1951 GTCGGCTACC GCAGCCGCAT TGACAACTAC ATCCACAACG
     TTTACGGGAA

2001 ATGGTGGGAT TTGAACGGGG ATATTCCGAG CTGGGTCGGC
     AGCACCGGGC

2051 TTGCCTACAC CATCCGACAC CGCAATTTCA AAGACAAAGT
     GCACAAACAC

2101 GGTTTTGAGC TGGAGCTGAA TTACGATTAT GGGCGTTTTT
     TCACCAACCT

2151 TTCTTACGCC TATCAAAAAA GCACGCAACC GACCAATTTC
     AGCGATGCGA

2201 GCGAATCGCC CAACAATGCC tccaaAGAAG ACCAACTCAA
     ACAAGGTTAT

2251 GGGCTGAGCA GGGTTTCCGC CCTGCCGCGA GATTACGGAC
     GTTTGGAAGT
```

-continued

```
2301 CGGTACGCGC TGGTTGGGCA ACAAACTGAC TTTGGGCGGC
     GCGAtgcGCT

2351 ATTTCGGCAA GAGCATCCGC GCGACGGCTG AAGAACGCTA
     TATCGACGGC

2401 ACCAACGGGG GAAATACCAG CAATGTCCGG CAACTGGGCA
     AGCGTTCCAT

2451 CAAACAAACC GAAACCCTTG CCCGACAGCC TTTGATTTTT
     GATTTTTACG

2501 CCGCTTACGA GCCGAAGAAA AACCTTATTT TCCGCGCCGA
     AGTCAAAAAC

2551 CTGTTCGACA GGCGTTATAT CGATCCGCTC GATGCGGGCA
     ATGATGCGGC

2601 AACGCAGCGT TATTACAGCT CGTTCGACCC GAAAGACAAG
     GACGAAGACG

2651 TAACGTGTAA TGCTGATAAA ACGTTGTGCA ACGGCAAATA
     CGGCGGCACA

2701 AGCAAAAGCG TATTGACCAA TTTCGCACGC GGACGCACCT
     TCTTGATGAC

2751 GATGAGCTAC AAGTTTTAA
```

This corresponds to the amino acid sequence <SEQ ID 884; ORF133ng-1>:

```
  1 MRSSFRLKPI CFYLMGVMLY HHSYAEDAGR AGSEAQIQVL
    EDVHVKAKRV

51 PKDKKVFTDA RAVSTRQDVF KSGENLDNIV RSIPGAFTQQ
    DKSSGIVSLN

101 IRGDSGFGRV NTMVDGITQT FYSTSTDAGR AGGSSQFGAS
    VDSNFIAGLD

151 VVKGSFSGSA GINSLAGSAN LRTLGVDDVV QGNNTYGLLL
    KGLTGTNSTK

201 GNAMAAIGAR KWLESGASVG VLYGHSRRGV AQNYRVGGGG
    QHIGNFGEEY

251 LERRKQQYFV QEGGLKFNAG SGKWERDLQR QYWKTKWYKK
    YEDPQELQKY

301 IEEHDKSWRE NLAPQYDITP IDPSGLKQQS AGNLFKLEYD
    GVFNKYTAQF

351 RDLNTRIGSR KIINRNYQFN YGLSLNPYTN LNLTAAYNSG
    RQKYPKGAKF

401 TGWGLLKDFE TYNNAKILDL NNTATFRLPR ETELQTTLGF
    NYFHNEYGKN

451 RFPEELGLFF DGPDQDNGLY SYLGRFKGDK GLLPQKSTIV
    QPAGSQYFNT

501 FYFDAALKKD IYRLNYSTNA INYRFGGEYT GYYGSENEFK
    RAFGENSPAY

551 KEHCDPSCGL YEPVLKKYGK KRANNHSVSI SADFGDYFMP
    FAGYSRTHRM

601 PNIQEMYFSQ IGDSGVHTAL KPERANTWQF GFNTYKKGLL
    KQDDILGLKL

651 VGYRSRIDNY IHNVYGKWWD LNGDIPSWVG STGLAYTIRH
    RNFKDKVHKH

701 GFELELNYDY GRFFTNLSYA YQKSTQPTNF SDASESPNNA
    SKEDQLKQGY

751 GLSRVSALPR DYGRLEVGTR WLGNKLTLGG ANRYFGKSIR
    ATAEERYIDG

801 TNGGNTSNVR QLGKRSIKQT ETLARQPLIF DFYAAYEPKK
    NLIFRAEVKN

851 LFDRRYIDPL DAGNDAATQR YYSSFDPKDK DEDVTCNADK
    TLCNGKYGGT

901 SKSVLTNFAR GRTFLMTMSY KF*
```

ORF133ng-1 and ORF133-1 show 96.2% identity in 889 aa overlap:

```
                        10        20        30        40        50        60
orf133ng-1.pep  SFRLKPICFYLMGVMLYHHSYAEDAGRAGSEAQIQVLEDVHVKAKRVPKDKKVFTDARAV
                                              ||||||||||||||||||||||||||||||
orf133-1                                      EAQIQVLEDVHVKAKRVPKDKKVFTDARAV
                                                       10        20        30

70        80        90       100       110       120
orf133ng-1.pep  STRQDVFKSGENLDNIVRSIPGAFTQQDKSSGIVSLNIRGDSGFGRVNTBVDGITQTFYS
                ||||:|| :||||||||||||||||||||||||||||||||||||||||||||||||||
orf133-1        STRQDIFKSSENLDNIVRSIPGAFTQQDKSSGIVSLNIRGDSGFGRVNTMVDGITQTFYS
                        40        50        60        70        80        90

130       140       150       160       170       180
orf133ng-1.pep  TSTDAGRAGGSSQFGASVDSNFIAGLDVVKGSFSGSAGINSLAGSANLRTLGVDDVVQGN
                ||||||||||||||||||||||||||||||||||||||||||||||||||||||||||||
orf133-1        TSTDAGRAGGSSQFGASVDSNFIAGLDVVKGSFSGSAGINSLAGSANLRTLGVDDVVQGN
                       100       110       120       130       140       150

190       200       210       220       230       240
orf133ng-1.pep  NTYGLLLKGLTGTNSTKGNAMAAIGARKWLESGASVGVLYGHSRRGVAQNYRVGGGGQHI
                |||||||||||||||||||||||||||||||||||||||||||||:|||||||||||||
orf133-1        NTYGLLLKGLTGTNSTKGNAMAAIGARKWLESGASVGVLYGHSRRSVAQNYRVGGGGQHI
                       160       170       180       190       200       210

250       260       270       280       290       300
orf133ng-1.pep  GNFGEEYLERRKQQYFVQEGGLKFNAGSGKWERDLQRQYWKTKWYKKYEDPQELQKYIEE
                ||||  ||||||:||:|||||:||| |||||||||||:|| ||| :::  |||||||||
orf133-1        GNFGAEYLERRKQRYFVQEGALKFNSDSGKWERDLQRQQWKYKPYKNYN-QELQKYIEE
                       220       230       240       250       260
```

-continued

```
                 310        320        330        340        350        360
orf133ng-1.pep   HDKSWRENLAPQYDITPIDPSGLKQQSAGNLFKLEYDGVFNKYTAQFRDLNTRIGSRKII
                 ||||||||| |||||||||||||| ||||||||||||||||||||||||||||:||||||
orf133-1         HDKSWRENLXPQYDITPIDPSSLKQQSAGNLFKLEYDGVFNKYTAQFRDLNTKIGSRKII
                 270        280        290        300        310        320

370        380        390        400        410        420
orf133ng-1.pep   NRNYQFNYGLSLNPYTNLNLTAAYNSGRQKYPKGAKFTGWGLLKDFETYNNAKILDLNNT
                 ||||||||||||||||||||||||||||||||||||:|||||||||||||||||||||||
orf133-1         NRNYQFNYGLSLNPYTNLNLTAAYNSGRQKYPKGSKFTGWGLLKDFETYNNAKILDLNNT
                 330        340        350        360        370        380

430        440        450        460        470        480
orf133ng-1.pep   ATFRLPRETELQTTLGFNYFHNEYGKNRFPEELGLFFDGPDQDNGLYSYLGRFKGDKGLL
                 ||||||||||||||||||||||||||||||||||||||||||||||||||||||||||||
orf133-1         ATFRLPRETELQTTLGFNYFHNEYGKNRFPEELGLFFDGPDQDNGLYSYLGRFKGDKGLL
                 390        400        410        420        430        440

490        500        510        520        530        540
orf133ng-1.pep   PQKSTIVQPAGSQYFNTFYFDAALKKDIYRLNYSTNAINYRFGGEYTGYYGSENEFKRAF
                 ||||||||||||||||||||||||||||||||||:::|||||||||||||||:::|||||
orf133-1         PQKSTIVQPAGSQYFNTFYFDAALKKDIYRLNYSTNTVGYRFGGEYTGYYGSDDEFKRAF
                 450        460        470        480        490        500

550        560        570        580        590        600
orf133ng-1.pep   GENSPAYKEHCDPSCGLYEPVLKKYGKKRANNHSVSISADFGDYFMPFAGYSRTHRMPNI
                 |||||:||:||:|   |||:|||||||||||||||||||||||||||||:||||||||||
orf133-1         GENSPTYKKHCNRSCGIYEPVLKKYGKKRANNHSVSISADFGDYFMPFASYSRTHRMPNI
                 510        520        530        540        550        560

610        620        630        640        650        660
orf133ng-1.pep   QEMYFSQIGDSGVHTALKPERANTWQFGFNTYKKGLLKQDDILGLKLVGYRSRIDNYIHN
                 ||||||||||||||||||||||||||||||||||||||||||| ||||||||||||||||
orf133-1         QEMYFSQIGDSGVHTALKPERANTWQFGFNTYKKGLLKQDDTLGLKLVGYRSRIDNYIHN
                 570        580        590        600        610        620

670        680        690        700        710        720
orf133ng-1.pep   VYGKWWDLNGDIPSWVGSTGLAYTIRHRNFKDKVHKHGFELELNYDYGRFFTNLSYAYQK
                 |||||||||||||||| :||||||| |||||||||||||||||||||||||||||||||
orf133-1         VYGKWWDLNGDIPSWVSSTGLAYTIQHRNFKDKVHKHGFELELNYDYGRFFTNLSYAYQK
                 630        640        650        660        670        680

730        740        750        760        770        780
orf133ng-1.pep   STQPTNFSDASESPNNASKEDQLKQGYGLSRVSALPRDYGRLEVGTRWLGNKLTLGGAMR
                 ||||||||||||||||||||||||||||||||||||||||||||||||||||||||||||
orf133-1         STQPTNFSDASESPNNASKEDQLKQGYGLSRVSALPRDYGRLEVGTRWLGNKLTLGGAMR
                 690        700        710        720        730        740

790        800        810        820        830        840
orf133ng-1.pep   YFGKSIRATAEERYIDGTNGGNTSNVRQLGKRSIKQTETLARQPLIFDFYAAYEPKKNLI
                 |||||||||||||||||||||||| |||||||||||||||||||||||||||||||||||
orf133-1         YFGKSIRATAEERYIDGTNGGNTSNFRQLGKRSIKQTETLARQPLIFDFYAAYEPKKNLI
                 750        760        770        780        790        800

850        860        870        880        890        900
orf133ng-1.pep   FRAEVKNLFDRRYIDPLDAGNDAATQRYYSSFDPKDKDEDVTCNADKTLCNGKYGGTSKS
                 ||||||||||||||||||||||||||||||||||||||||||||||||||||||||||||
orf133-1         FRAEVKNLFDRRYIDPLDAGNDAATQRYYSSFDPKDKDEDVTCNADKTLCNGKYGGTSKS
                 810        820        830        840        850        860

910        920
orf133ng-1.pep   VLTNFARGRTFLMTMSYKFX
                 ||||||||||||||||||||
orf133-1         VLTNFARGRTFLMTMSYKFX
                 870        880
```

In addition, ORF133ng-1 is homologous to a TonB-dependent receptor in *H. influenzae*:

```
sp|P45114|YC17_HAEIN PROBABLE TONB-DEPENDENT RECEPTOR HI1217 PRECURSOR
>gi|1075372|pir||G64110 transferrin binding protein 1 precursor (tbp1) homolog -
Haemophilus influenzae (strain Rd KW20) >gi|1574147| (U32801) transferrin binding
protein 1 precursor (tbp1) [Haemophilus influenzae] Length = 913
Score = 930 bits (2377), Expect = 0.0
Identities = 476/921 (51%), Positives = 619/921 (66%), Gaps = 72/921 (7%)

Query:  38  QVLEDVHVKAKRVPKDKKVFTDARAVSTRQDVFKSGENLDNIVRSIPGAFTQQDKSSGIV   97
             + L   + V  K +   DKK FT+A+A STR++VFK   +D ++RSIPGAFTQQKD SG+V
Sbjct:  29  ETLGQIDVVEKVISNDKKPFTEAKAKSTRENVFKETQTIDQVIRSIPGAFTQQDKGSGVV   88
```

-continued

```
Query:   98 SLNIRGDSGFGRVNTMVDGITQTFYSTSTDAGRAGGSSQFGASVDSNFIAGLDVVKGSFS  157
            S+NIRG++G GRVNTMVDG+TQTFYST+ D+G++GGSSQFGA++D NFIAG DV K +FS
Sbjct:   89 SVNIRGENGLGRVNTMVDGVTQTFYSTALDSGQSGGSSQFGAAIDPNFIAGVDVNKSNFS  148

Query:  158 GSAGINSLAGSANLRTLGVDDVVQXXXXXXXXXXXXXXXXXXXXXXXAMAAIGARKWLESGA  217
            G++GIN+LAGSAN RTLGV+DV+                   M    RKWL++G
Sbjct:  149 GASGINALAGSANFRTLGVNDVITDDKPFGIILKGMTGSNATKSNFMTMAAGRKWLDNGG  208

Query:  218 SVGVLYGHSRRGVAQNYRVGGGGQHIGNFGEEYLERRKQQYFVQEGGLKFNAGSGKWERD  277
             VGV+YG+S+R V+Q+YR+ GGG+ + + G++ L + K+ YF + G   N   G+W D
Sbjct:  209 YVGVVYGYSQREVSQDYRI-GGGERLASLGQDILAKEKEAYF-RNAGYILNP-EGQWTPD  265

Query:  278 LQRQYWK-----------TKWY-------------------KKYEDPQELQK---YIEE  303
            L +++W           +Y                   KK +D ++LQK    IEE
Sbjct:  266 LSKKHWSCNKPDYQKNCDCSYYRIGSAAKTRREILQELLTNGKKPKDIEKLQKGNDGIEE  325

Query:  304 HDKSWRENLAPQYDITPIDPSGLKQQSAGNLFKLEYDGVFNKYTAQFRDLNTRIGSRKII  363
            DKS+ N   QY + PI+P  L+ +S  +L K EY        AQ R L+ +IGSRKI
Sbjct:  326 TDKSFERN-KDQYSVAPIEPGSLQSRSRSHLLKFEYGDDHQNLGAQLRTLDNKIGSRKIE  384

Query:  364 NRNYQFNYGLSLNPYTNLNLTAAYNSGRQKYPKGAKFTGWGLLKDFETYNNAKILDLNNT  423
            NRNYQ NY + N Y +LNL AA+N G+  YPKG  F GW +    T N A I+D+NN+
Sbjct:  385 NRNYQVNYNFNNNSYLDLNLMAAHNIGKTIYPKGGFFAGWQVADKLITKNVANIVDINNS  444

Query:  424 ATFRLPRETELQTTLGFNYFHNEYGKNRFPEELGLFFDGPDQDNGLYSY--LGRFKGDKG  481
             TF LP+E +L+TTLGFNYF NEY KNRFPEEL LF++    D GLYS+   GR+ G K
Sbjct:  445 HTFLLPKEIDLKTTLGFNYFTNEYSKNRFPEELSLFYNDASHDQGLYSHSKRGRYSGTKS  504

Query:  482 LLPQKSTIVQPAGSQYFNTFYFDAALKKDIYRLNYSTNAINYRFGGEYTGYYGSENEFKR  541
            LLPQ+S I+QP+G Q F T YFD AL K  IY LNYS N  +Y F GEY GY
Sbjct:  505 LLPQRSVILQPSGKQKFKTVYFDTALSKGIYHLNYSVNFTHYAFNGEYVGY---------  555

Query:  542 AFGENSPAYKEHCDPSCGLYEPVLKKYGKKRANNHSVSISADFGDYFMPFAGYSRTHRMP  601
             EN+    +    + EP+L K G K+a NHS ++SA+  DYFMPF  YSRTHRMP
Sbjct:  556 ---ENTAGQQ--------INEPILHKSGHKKAFNHSATLSAELSDYFMPFFTYSRTHRMP  604

Query:  602 NIQEMYFSQIGDSGVHTALKPERANTWQFGFNTYKKGLLKQDDILGLKLVGYRSRIDNYI  661
            NIQEM+FSQ+ ++GV+TALKPE+++T+Q GFNTYKKGL  QDD+LG+KLVGYRS I NYI
Sbjct:  605 NIQEMFFSQVSNAGVNTALKPEQSDTYQLGFNTYKKGLFTQDDVLGVKLVGYRSFIKNYI  664

Query:  662 HNVYGKWWDLNGDIPSWVGSTGLAYTIRHRNFKDKVHKHGFELELNYDYGRFFTNLSYAY  721
            HNVYG WW       +P+W  S G  YTI H+N+K  V K G ELE+NYD GRFF N+SYAY
Sbjct:  665 HNVYGVWW--RDGMPTWAESNGFKYTIAHQNYKPIVKKSGVELEINYDMGRFFANVSYAY  722

Query:  722 QKSTQPTNFSDASESPNNASKEDQLKQGYGLSRVSALPRDYGRLEVGTRWLGNKLTLGGA  781
            Q++QPTN++DAS  PNNAS+ED LKQGYGLSRVS LP+DYGRLE+GTRW    KLTLG A
Sbjct:  723 QRTNQPTNYADASPRPNNASQEDILKQGYGLSRVSMLPKDYGRLELGTRWFDQKLTLGLA  782

Query:  782 MRYFGKSIRATAEERYIDGTNGGNTSNVRQLGKRSIKQTETLARQPLIFDFYAAYEPKKN  841
              RY+GKS RAT EE YI+G+     + +R+    ++K+TE + +QP+I D + +YEP K+
Sbjct:  783 ARYYGKSKRATIEEEYINGSR-FKKNTLRRENYYAVKKTEDIKKQPIILDLHVSYEPIKD  841

Query:  842 LIFRAEVKNLFDRRYIDPLDAGNDAATQRYYSSFDPKDKDEDVTCNADKTLCNGKYGGTS  901
            LI +AEV NL D+RY+DPLDAGNDAA+QRYYSS      +  + C  D + C    GG+
Sbjct:  842 LIIKAEVQNLLDKRYVDPLDAGNDAASQRYYSSL-----NNSIECAQDSSAC----GGSD  892

Query:  902 KSVLTNFARGRTFLMTMSYKF                                        922
            K+VL NFARGRT++++++YKF
Sbjct:  893 KTVLYNFARGRTYILSLNYKF                                        913
```

The underlined motif in the gonococcal protein (also present in the meningococcal protein) is predicted to be an ATP/GTP-binding site motif A (P-loop), and the analysis suggests that these proteins from *N. meningitidis* and *N. gonorrhoeae*, and their epitopes, could be useful antigens for vaccines or diagnostics, or for raising antibodies.

Example 104

The following partial DNA sequence was identified in *N. meningitidis* <SEQ ID 885>

```
  1 ATGAACCTGA TTTCACGTTA CATCATCCGT CAAATGGCGG TTATGGCGGT

51 TTACGCGCTC CTTGCCTTCC TCGCTTTGTA CAGCTTTTTT GAAATCCTGT

101 ACGAAACCGG CAACCTCGGC AAAGGCAGTT ACGGCATATG GGAAATGCTG

151 GGCTACACCG CCCTCAAAAT GCCCGCCCGC GCCTACGAAC TGATTCCCCT

201 CGCCGTCCTT ATCGGCGGAC TGGTCTCCCT CAGCCAGCTT GCCGCCGGCA

251 GCGAACTGAC CGTCATCAAA GCCAGCGGCA TGAGCACCAA AAAGCTGCTG

301 TTGATTCTGT CGCAGTTCGG TTTTATTTTT GCTATTGCCA CCGTCGCGCT

351 CGGCGAATGG GTTGCGCCCA CACTGAGCCA AAAAGCCGAA AACATCAAAG

401 CCGCCGCCAT CAACGGCAAA ATCAGCACCG GCAATACCGG CCTTTGGCTG

451 AAAGAAAAAA ACAGCGTGAT CAATGTGCGC GAAATGTTGC CCGACCAT..
```

This corresponds to the amino acid sequence <SEQ ID 886; ORF112>:

```
  1 MNLISRYIIR QMAVMAVYAL LAFLALYSFF EILYETGNLG KGSYGIWEML

51 GYTALKMPAR AYELIPLAVL IGGLVSLSQL AAGSELTVIK ASGMSTKKLL

101 LILSQFGFIF AIATVALGEW VAPTLSQKAE NIKAAAINGK ISTGNTGLWL

151 KEKNSVINVR EMLPDH...
```

Further work revealed further partial nucleotide sequence <SEQ ID 887>:

```
  1 ATGAACCTGA TTTCACGTTA CATCATCCGT CAAATGGCGG TTATGGCGGT

51 TTACGCGCTC CTTGCCTTCC TCGCTTTGTA CAGCTTTTTT GAAATCCTGT

101 ACGAAACCGG CAACCTCGGC AAAGGCAGTT ACGGCATATG GGAAATGCTC 151 gGCTACACCG CCCTCAAAAT GCCCGCCCGC GCCTACGAAC TGATTCCCCT

201 CGCCGTCCTT ATCGGCGGAC TGGTCTCCCT CAGCCAGCTT GCCGCCGGCA

251 GCGAACTGAC CGTCATCAAA GCCAGCGGCA TGAGCACCAA AAAGCTGCTG

301 TTGATTCTGT CGCAGTTCGG TTTTATTTTT GCTATTGCCA CCGTCGCGCT

351 CGGCGAATGG GTTGCGCCCA CACTGAGCCA AAAAGCCGAA AACATCAAAG

401 CCGCCGCCAT CAACGGCAAA ATCAGCACCG GCAATACCGG CCTTTGGCTG

451 AAAGAAAAAA ACAGCrTkAT CAATGTGCGC GAAATGTTGC CCGACCATAC

501 GCTTTTGGGC ATCAAAATTT GGGCGCGCAA CGATAAAAAC GAATTGGCAG

551 AGGCAGTGGA AGCCGATTCC GCCGTTTTGA ACAGCGACGG CAGTTGGCAC
```

-continued

```
601  TTGAAAAACA TCCGCCGCAG CACGCTTGGC GAAGACAAAG TCGAGGTCTC

651  TATTGCGGCT GAAGAAAACT GGCCGATTTC CGTCAAACGC AACCTGATGG

701  ACGTATTGCT CGTCAAACCC GACCAAATGT CCGTCGGCGA ACTGACCACC

751  TACATCCGCC ACCTCCAAAA CAACAGCCAA ACACCCGAA TCTACGCCAT

801  CGCATGGTGG CGCAAATTGG TTTACCCCGC CGCAGCCTGG GTGATGGCGC

851  TCGTCGCCTT TGCCTTTACC CCGCAAACCA CCCGCCACGG CAATATGGGC

901  TTAAAACTCT TCGGCGGCAT CTGTsTCGGA TTGCTGTTCC ACCTTGCCGG

951  ACGGCTCTTT GGGTTTACCA GCCAACTCGG...
```

This corresponds to the amino acid sequence <SEQ ID 888; ORF112-1>:

```
  1  MNLISRYIIR QMAVMAVYAL LAFLALYSFF EILYETGNLG KGSYGIWEML

51  GYTALKMPAR AYELIPLAVL IGGLVSLSQL AAGSELTVIK ASGMSTKKLL

101  LILSQFGFIF AIATVALGEW VAPTLSQKAE NIKAAAINGK ISTGNTGLWL

151  KEKNSXINVR EMLPDHTLLG IKIWARNDKN ELAEAVEADS AVLNSDGSWQ

201  LKNIRRSTLG EDKVEVSIAA EENWPISVKR NLMDVLLVKP DQMSVGELTT

251  YIRHLQNNSQ NTRIYAIAWW RKLVYPAAAW VMALVAFAFT PQTTRHGNMG

301  LKLFGGICXG LLFHLAGRLF GFTSQL...
```

Computer analysis of this amino acid sequence predicts two transmembrane domains and gave the following results:

Homology with a Predicted ORF from *N. meningitidis* (Strain A)

ORF112 shows 96.4% identity over a 166aa overlap with an ORF (ORF112a) from strain A of *N. meningitidis*:

```
                  10         20         30         40         50         60
orf112.pep   MNLISRYIIRQMAVMAVYALLAFLALYSFFEILYETGNLGKGSYGIWEMLGYTALKMPAR
             ||||||||||||||||||||||||||||||||||||||||||||||| |||||| ||
orf112a      MNLISRYIIRQMAVMAVYALLAFLALYSFFEILYETGNLGKGSYGIWEMXGYTALKMXAR
                  10         20         30         40         50         60

70         80         90        100        110        120
orf112.pep   AYELIPLAVLIGGLVSLSQLAAGSELTVIKASGMSTKKLLLILSQFGFIFAIATVALGEW
             ||||:||||||||||| ||||||||||:||||||||||||||||||||||||||||||||
orf112a      AYELMPLAVLIGGLVSXSQLAAGSELXVIKASGMSTKKLLLILSQFGFIFAIATVALGEW
                  70         80         90        100        110        120

130        140        150        160
orf112.pep   VAPTLSQKAENIKAAAINGKISTGNTGLWLKEKNSVINVREMLPDH
             |||||||||||||||||||||||||||||||||||:|||||||||
orf112a      VAPTLSQKAENIKAAAINGKISTGNTGLWLKEKNSIINVREMLPDHTLLGIKIWARNDKN
                 130        140        150        160        170        180 orf112a      ELAEAVEADSAVLNSDGSWQLKNIRRSTLGEDKVEVSIAAEEXWPISVKRNLMDVLLVKP
                 190        200        210        220        230        240
```

The ORF112a nucleotide sequence <SEQ ID 889> is:

```
  1 ATGAACCTGA TTTCACGTTA CATCATCCGT CAAATGGCGG TTATGGCGGT
 51 TTACGCGCTC CTTGCCTTCC TCGCTTTGTA CAGCTTTTTT GAAATCCTGT
101 ACGAAACCGG CAACCTCGGC AAAGGCAGTT ACGGCATATG GGAAATGNTG
151 GGNTACACCG CCCTCAAAAT GNCCGCCCGC GCCTACGAAC TGATGCCCCT
201 CGCCGTCCTT ATCGGCGGAC TGGTCTCTNT CAGCCAGCTT GCCGCCGGCA
251 GCGAACTGAN CGTCATCAAA GCCAGCGGCA TGAGCACCAA AAAGCTGCTG
301 TTGATTCTGT CGCAGTTCGG TTTTATTTTT GCTATTGCCA CCGTCGCGCT
351 CGGCGAATGG GTTGCGCCCA CACTGAGCCA AAAAGCCGAA AACATCAAAG
401 CCGCGGCCAT CAACGGCAAA ATCAGTACCG GCAATACCGG CCTTTGGCTG
451 AAAGAAAAAA ACAGCATTAT CAATGTGCGC GAAATGTTGC CCGACCATAC
501 CCTGCTGGGC ATTAAAATCT GGGCCCGCAA CGATAAAAAC GAACTGGCAG
551 AGGCAGTGGA AGCCGATTCC GCCGTTTTGA ACAGCGACGG CAGTTGGCAG
601 TTGAAAAACA TCCGCCGCAG CACGCTTGGC GAAGACAAAG TCGAGGTCTC
651 TATTGCGGCT GAAGAAAANT GGCCGATTTC CGTCAAACGC AACCTGATGG
701 ACGTATTGCT CGTCAAACCC GACCAAATGT CCGTCGGCGA ACTGACCACC
751 TACATCCGCC ACCTCCAAAN NNACAGCCAA AACACCCGAA TCTACGCCAT
801 CGCATGGTGG CGCAAATTGG TTTACCCCGC CGCAGCCTGG GTGATGGCGC
851 TCGTCGCCTT TGCCTTTACC CCGCAAACCA CCCGCCACGG CAATATGGGC
901 TTAAAANTCT TCGGCGGCAT CTGTCTCGGA TTGCTGTTCC ACCTTGCCGG
951 NCGGCTCTTC NGGTTTACCA GCCAACTCTA CGGCATCCCG CCCTTCCTCG
1001 NCGGCGCACT ACCTACCATA GCCTTCGCCT TCCTCGCCGT TTGGCTGATA
1051 CGCAAACAGG AAAAACGCTA A
```

This encodes a protein having the amino acid sequence <SEQ ID 890>:

```
  1 MNLISRYIIR QMAVMAVYAL LAFLALYSFF EILYETGNLG KGSYGIWEMX
 51 GYTALKMXAR AYELMPLAVL IGGLVSXSQL AAGSELXVIK ASGMSTKKLL
101 LILSQFGFIF AIATVALGEW VAPTLSQKAE NIKAAAINGK ISTGNTGLWL
151 KEKNSIINVR EMLPDHTLLG IKIWARNDKN ELAEAVEADS AVLNSDGSWQ
201 LKNIRRSTLG EDKVEVSIAA EEXWPISVKR NLMDVLLVKP DQMSVGELTT
251 YIRHLQXXSQ NTRIYAIAWW RKLVYPAAAW VMALVAFAFT PQTTRHGNMG
301 LKXFGGICLG LLFHLAGRLF XFTSQLYGIP PFLXGALPTI AFALLAVWLI
351 RKQEKR*
```

ORF112a and ORF112-1 show 96.3% identity in 326 aa overlap:

```
orf112a.pep  MNLISRYIIRQMAVMAVYALLAFLALYSFFEILYETGNLGKGSYGIWEMXGYTALKMXAR
             ||||||||||||||||||||||||||||||||||||||||||||||||||| |||||| |
orf112-1     MNLISRYIIRQMAVMAVYALLAFLALYSFFEILYETGNLGKGSYGIWEMLGYTALKMPAR
```

-continued

```
orf112a.pep    AYELMPLAVLIGGLVSXSQLAAGSELXVIKASGMSTKKLLLILSQFGFIFAIATVALGEW
               ||||:|||||||||||  ||||||||:|||||||||||||||||||||||||||||||||
orf112-1       AYELIPLAVLIGGLVSLSQLAAGSELTVIKASGMSTKKLLLILSQFGFIFAIATVALGEW
orf112a.pep    VAPTLSQKAENIKAAAINGKISTGNTGLWLKEKNSIINVREMLPDHTLLGIKIWARNDKN
               ||||||||||||||||||||||||||||||||||||||| ||||||||||||||||||||
orf112-1       VAPTLSQKAENIKAAAINGKISTGNTGLWLKEKNSXINVREMLPDHTLLGIKIWARNDKN
orf112a.pep    ELAEAVEADSAVLNSDGSWQLKNIRRSTLGEDKVEVSIAAEEXWPISVKRNLMDVLLVKP
               ||||||||||||||||||||||||||||||||||||||||||||| ||||||||||||||
orf112-1       ELAEAVEADSAVLNSDGSWQLKNIRRSTLGEDKVEVSIAAEENWPISVKRNLMDVLLVKP
orf112a.pep    DQMSVGELTTYIRHLQXXSQNTRIYAIAWWRKLVYPAAAWVMALVAFAFTPQTTRHGNMG
               |||||||||||||||||  |||||||||||||||||||||||||||||||||||||||||
orf112-1       DQMSVGELTTYIRHLQNNSQNTRIYAIAWWRKLVYPAAAWVMALVAFAFTPQTTRHGNMG
orf112a.pep    LKXFGGICLGLLFHLAGRLFXFTSQLYGIPPFLXGALPTIAFALLAVWLIRKQEKRX
               || |||||| |||||||||||  |||||
orf112-1       LKLFGGICXGLLFHLAGRLFGFTSQL
```

Homology with a Predicted ORF from *N. gonorrhoeae*
ORF112 shows 95.8% identity over 166aa overlap with a predicted ORF (ORF112ng) from *N. gonorrhoeae*:

```
orf112.pep     MNLISRYIIRQMAVMAVYALLAFLALYSFFEILYETGNLGKGSYGIWEMLGYTALKMPAR    60
               ||||||||||||||||||||||||||||||||||||||||||||||||||||||||||||
orf112ng       MNLISRYIIRQMAVMAVYALLAFLALYSFFEILYETGNLGKGSYGIWEMLGYTALKMPAR    60
orf112.pep     AYELIPLAVLIGGLVSLSQLAAGSELTVIKASGMSTKKLLLILSQFGFIFAIATVALGEW   120
               ||||:||||||||| :||||||||||:|||||||||||||||||||||||||:|||||||
orf112ng       AYELMPLAVLIGGLASLSQLAAGSELAVIKASGMSTKKLLLILSQFGFIFAIAAVALGEW   120
orf112.pep     VAPTLSQKAENIKAAAINGKISTGNTGLWLKEKNSVINVREMLPDH                 166
               ||||||||||||||||||||||||||||||||||: :|||| |||||
orf112ng       VAPTLSQKAENIKAAAINGKISTGNTGLWLKEKTSIINVRGMLPDHTLLGIKIWARNDKN   180
```

The complete length ORF112ng nucleotide sequence <SEQ ID 891> is:

```
  1 ATGAACCTGA TTTCACGTTA CATCATCCGC CAAATGGCGG TTATGGCGGT
 51 TTACGCGCTC CTTGCCTTCC TCGCTTTGTA CAGCTTTTTT GAAATCCTGT
101 ACGAAACCGG CAACCTCGGC AAAGGCAGTT ACGGCATATG GGAAATGCTG
151 GGCTACACCG CCCTCAAAAT GCCCGCCCGC GCCTACGAAC TCATGCCCCT
201 CGCCGTCCTC ATCGGCGGAC TGGCCTCTCT CAGCCAGCTT GCCGCCGGCA
251 GCGAACTGGC CGTCATCAAA GCCAGCGGCA TGAGCACCAA AAAGCTGCTG
301 TTGATTCTGT CTCAGTTCGG TTTTATTTTT GCTATTGCCG CCGTCGCGCT
351 CGGCGAATGG GTTGCGCCCA CGCTGAGCCA AAAAGCCGAA AACATCAAag
401 cCGCCGCCAt taacggCAAA ATCAGCAccg gcAATACCGG CCTTTggCTG
451 AAAGAAAAAa ccAGCATTAT CAATGTGcGc GGAATGTTGC CCGACCATAC
501 GCTTTTGGGC ATCAAAATTT GGGCGCGCAA CGATAAAAAC GAATTGGCAG
551 AGGCAGTGGA AGCCGATTCC GCCGTTTTGA ACAGCGACGG CAGCTGGCAG
601 TTGAAAAACA TCCGCCGCAG CATCATGGGT ACAGACAAAA TCGAAACATC
651 cgCCGCCGCC GAAGAAACTT gGCCGATTGC CGTCAGACGC AACCTGATGG
701 ACGTATTGCT CGTCAAGCCC GACCAAATGT CCGTCGGCGA GCTGACCACC
751 TACATCCGCC ACCTCCAAAA CAACAGCCAA ACACCCAAA TCTACGCCAT
801 CGCATGGTGG CGTAAACTCG TTTACCCCGT CGCCGCATGG GTCATGGCGC
851 TCGTTGCCTT CGCCTTTACG CCGCAAACCA CGCGCCACGG CAATATGGGC
```

```
-continued
 901 TTAAAACTCT TCGGCGGCAT CTGTCTCGGA TTGCTGTTCC ACCTTGCCGG

951 CAGGCTCTTC GGGTTTACCA GCCAACTCTA CGGCACCCCA CCCTTCCTCG

1001 CCGGCGCACT GCCTACCATA GCCTTCGCCT TGCTCGCTGT TTGGCTGATA

1051 CGCAAACAGG AAAAACGTTG A
```

This encodes a protein having amino acid sequence <SEQ ID 892>:

```
  1 MNLISRYIIR QMAVMAVYAL LAFLALYSFF EILYETGNLG
    KGSYGIWEML

51 GYTALKMPAR AYELMPLAVL IGGLASLSQL AAGSELAVIK
    ASGMSTKKLL

101 LILSQFGFIF AIAAVALGEW VAPTLSQKAE NIKAAAINGK
    ISTGNTGLWL

151 KEKTSIINVR GMLPDHTLLG IKIWARNDKN ELAEAVEADS
    AVLNSDGSWQ

201 LKNIRRSIMG TDKIETSAAA EETWPIAVRR NLMDVLLVKP
    DQMSVGELTT

251 YIRHLQNNSQ NTQIYAIAWW RKLVYPVAAW VMALVAFAFT
    PQTTRHGNMG

301 LKLFGGICLG LLFHLAGRLF GFTSQLYGTP PFL
    AGALPTI AFALLAVWLI

352 RKQEKR*
```

ORF112ng and ORF112-1 show 94.2% identity in 326 aa overlap:

```
                  10         20         30         40         50         60
orf112ng  MNLISRYIIRQMAVMAVYALLAFLALYSFFEILYETGNLGKGSYGIWEMLGYTALKMPAR
          ||||||||||||||||||||||||||||||||||||||||||||||||||||||||||||
orf112-1  MNLISRYIIRQMAVMAVYALLAFLALYSFFEILYETGNLGKGSYGIWEMLGYTALKMPAR
                  10         20         30         40         50         60

70         80         90        100        110        120
orf112ng  AYELMPLAVLIGGLASLSQLAAGSELAVIKASGMSTKKLLLILSQFGFIFAIAAVALGEW
          ||||:||||||||||:||||||||||:|||||||||||||||||||||||||:|||||
orf112-1  AYELIPLAVLIGGLVSLSQLAAGSELTVIKASGMSTKKLLLILSQFGFIFAIATVALGEW
                  70         80         90        100        110        120

130        140        150        160        170        180
orf112ng  VAPTLSQKAENIKAAAINGKISTGNTGLWLKEKTSIINVRGMLPDHTLLGIKIWARNDKN
          |||||||||||||||||||||||||||||||||:| ||||||||||||||||||||||||
orf112-1  VAPTLSQKAENIKAAAINGKISTGNTGLWLKEKNSXINVREMLPDHTLLGIKIWARNDKN
                 130        140        150        160        170        180

190        200        210        220        230        240
orf112ng  ELAEAVEADSAVLNSDGSWQLKNIRRSIMGTDKIETSAAAEETWPIAVRRNLMDVLLVKP
          ||||||||||||||||||||||||||||:| ||:|:| ||||:|||:|:|||||||||||
orf112-1  ELAEAVEADSAVLNSDGSWQLKNIRRSTLGEDKVEVSIAAEENWPISVKRNLMDVLLVKP
                 190        200        210        220        230        240

250        260        270        280        290        300
orf112ng  DQMSVGELTTYIRHLQNNSQNTQIYAIAWWRKLVYPVAAWVMALVAFAFTPQTTRHGNMG
          |||||||||||||||||||||||:|||||||||||||:||||||||||||||||||||||
orf112-1  DQMSVGELTTYIRHLQNNSQNTRIYAIAWWRKLVYPAAWVMALVAFAFTPQTTRHGNMG
                 250        260        270        280        290        300

310        320        330        340        350
orf112ng  LKLFGGICLGLLFHLAGRLFGFTSQLYGTPPFLAGALPTIAFALLAVWLIRKQEKRX
          ||||||||  ||||||||||||||||
orf112-1  LKLFGGICXGLLFHLAGRLFGFTSQL
                 310        320
```

This analysis suggests that these proteins from *N. meningitidis* and *N. gonorrhoeae*, and their epitopes, could be useful antigens for vaccines or diagnostics, or for raising antibodies.

It will be appreciated that the invention has been described by means of example only, and that modifications may be made whilst remaining within the spirit and scope of the invention.

TABLE I

PCR primers

| ORF | Primer | Sequence | Restriction sites | |
|---|---|---|---|---|
| ORF 1 | Forward | CGC<u>GGATCC</u><u>GCTAGC</u>-GGACACACTTATTTCGG | BamHI-NheI | SEQ ID NO: 924 |
| | Reverse | CCCG<u>CTCGAG</u>-CCAGCGGTAGCCTAATT | XhoI | SEQ ID NO: 925 |
| ORF 2 | Forward | GC<u>GGATCC</u><u>CATATG</u>-TTTGATTTCGGTTTGGG | BamHI-NdeI | SEQ ID NO: 926 |
| | Reverse | CCCG<u>CTCGAG</u>-GACGGCATAACGGCG | XhoI | SEQ ID NO: 927 |
| ORF 2-1 | Forward | GC<u>GGATCC</u><u>CATATG</u>-TTTGATTTCGGTTTGGG | BamHI-NdeI | SEQ ID NO: 928 |
| | Reverse | CCCG<u>CTCGAG</u>-TGATTTACGGACGCGCA | XhoI | SEQ ID NO: 929 |
| ORF 4 | Forward | GC<u>GGATCC</u><u>CATATG</u>-TGCGGAGGTCAAAAAGAC | BamHI-NdeI | SEQ ID NO: 930 |
| | Reverse | CCCG<u>CTCGAG</u>-TTTGGCTGCGCCTTC | XhoI | SEQ ID NO: 931 |
| ORF 5 | Forward | GGAATTC<u>CATATGGCCATGG</u>-TGGAAGGCGCACAACC | NdeI-NcoI | SEQ ID NO: 932 |
| | Forward | CG<u>GGATCC</u>-ATGGAAGGCGCACAAC | BamHI | SEQ ID NO: 933 |
| | Reverse | CCCG<u>CTCGAG</u>-GACTGTGCAAAAACGG | XhoI | SEQ ID NO: 934 |
| ORF 6 | Forward | CGC<u>GGATCC</u><u>CATATG</u>-ACCCGTCAATCTCTGCA | BamHI-NdeI | SEQ ID NO: 935 |
| | Reverse | CCCG<u>CTCGAG</u>-TGCGCCGAACACTTTC | XhoI | SEQ ID NO: 936 |
| ORF 7 | Forward | CGC<u>GGATCC</u><u>GCTAGC</u>-GCGCTGCTTTTTGTTCC | BamHI-NheI | SEQ ID NO: 937 |
| | Reverse | CCCG<u>CTCGAG</u>-TTTCAAAATATATTTGCGGA | XhoI | SEQ ID NO: 938 |
| ORF 8 | Forward | GC<u>GGATCC</u><u>CATATG</u>-GCTCAACTGCTTCGTAC | BamHI-NdeI | SEQ ID NO: 939 |
| | Reverse | CCCG<u>CTCGAG</u>-AGCAGGCTTTGGCGC | XhoI | SEQ ID NO: 940 |
| ORF 9 | Forward | CGC<u>GGATCC</u><u>CATATG</u>-CCGAAGGAAGTCGGAAA | BamHI-NdeI | SEQ ID NO: 941 |
| | Reverse | CCCG<u>CTCGAG</u>-TTTCCGAGGTTTTCGGG | XhoI | SEQ ID NO: 942 |
| ORF 10 | Forward | GC<u>GGATCC</u><u>CATATG</u>-GACACAAAAGAAATCCTC | BamHI-NdeI | SEQ ID NO: 943 |
| | Reverse | CCCG<u>CTCGAG</u>-TAATGGGAAACCTTGTTTT | XhoI | SEQ ID NO: 944 |
| ORF 11 | Forward | GC<u>GGATCC</u><u>CATATG</u>-GCGGTCAACCTCTACG | BamHI-NdeI | SEQ ID NO: 945 |
| | Reverse | CCCG<u>CTCGAG</u>-GGAAACGACTTCGCC | XhoI | SEQ ID NO: 946 |
| ORF 13 | Forward | CGC<u>GGATCC</u><u>CATATG</u>-GCTCTGCTTTCCGCGC | BamHI-NdeI | SEQ ID NO: 947 |
| | Reverse | CCCG<u>CTCGAG</u>-AGGGTGTGTGATAATAAG | XhoI | SEQ ID NO: 948 |
| ORF 15 | Forward | GGAATTC<u>CATATGGCCATGG</u>-GCGGGACACTGACAG | NdeI-NcoI | SEQ ID NO: 949 |
| | Forward | CG<u>GGATCC</u>-TGCGGGACACTGACAGG | BamHI | SEQ ID NO: 950 |
| | Reverse | CCCG<u>CTCGAG</u>-AGGTTGGCCTTGTCTATG | XhoI | SEQ ID NO: 951 |
| ORF 17 | Forward | GGAATTC<u>CATATGGCCATGG</u>-TTGCCGGCCTGTTCG | NdeI-NcoI | SEQ ID NO: 952 |
| | Forward | CG<u>GGATCC</u>-ATTGCCGGCCTGTTCG | BamHI | SEQ ID NO: 953 |
| | Reverse | CCCG<u>CTCGAG</u>-AAGCAGGTTGTACAGC | XhoI | SEQ ID NO: 954 |
| ORF 18 | Forward | GC<u>GGATCC</u><u>CATATG</u>-ATTTTGCTGCATTTGGAT | BamHI-NdeI | SEQ ID NO: 955 |
| | Reverse | CCCG<u>CTCGAG</u>-TCTTCCAATTTCTGAAAGC | XhoI | SEQ ID NO: 956 |
| ORF 19 | Forward | GGAATTC<u>CATATGGCCATGG</u>-TCGCCAGTGTTTTTACC | NdeI-NcoI | SEQ ID NO: 957 |
| | Forward | CG<u>GGATCC</u>-TTCGCCAGTGTTTTTACCG | BamHI | SEQ ID NO: 958 |
| | Reverse | CCCG<u>CTCGAG</u>-GGTGTTTTTGAAGCTGCC | XhoI | SEQ ID NO: 959 |
| ORF 20 | Forward | GGAATTC<u>CATATGGCCATGG</u>-TCGGCGCGGGTATG | NdeI-NcoI | SEQ ID NO: 960 |
| | Forward | CG<u>GGATCC</u>-TTCGGCGCGGGTATG | BamHI | SEQ ID NO: 961 |
| | Reverse | CCCG<u>CTCGAG</u>-CGGCGAGCGAGAGCA | XhoI | SEQ ID NO: 962 |
| ORF 22 | Forward | GGAATTC<u>CATATGGCCATGG</u>-TGATTAAAATCAAAAAGGTCT | NdeI-NcoI | SEQ ID NO: 963 |
| | Forward | CG<u>GGATCC</u>-ATGATTAAAATCAAAAAGGTCTAAACC | BamHI | SEQ ID NO: 964 |
| | Reverse | CCCG<u>CTCGAG</u>-ATTATGATAGCGGCCC | XhoI | SEQ ID NO: 965 |
| ORF 23 | Forward | CGC<u>GGATCC</u><u>CATATG</u>-GATGTTTCTGTTTCAGAC | BamHI-NdeI | SEQ ID NO: 966 |
| | Reverse | CCCG<u>CTCGAG</u>-TTTAAACCGATAGGTAAACG | XhoI | SEQ ID NO: 967 |
| ORF 24 | Forward | GGAATTC<u>CATATGGCCATGG</u>-TGATGCCGGAAATGGTG | NdeI-NcoI | SEQ ID NO: 968 |
| | Forward | CG<u>GGATCC</u>-ATGATGCCGGAAATGGTG | BamHI | SEQ ID NO: 969 |
| | Reverse | CCCG<u>CTCGAG</u>-TGTCAGCGTGGCGCA | XhoI | SEQ ID NO: 970 |
| ORF 25 | Forward | GC<u>GGATCC</u><u>CATATG</u>-TATCGCAAACTGATTGC | BamHI-NdeI | SEQ ID NO: 971 |
| | Reverse | CCCG<u>CTCGAG</u>-ATCGATGGAATAGCCG | XhoI | SEQ ID NO: 972 |

TABLE I-continued

PCR primers

| ORF | Primer | Sequence | Restriction sites | |
|---|---|---|---|---|
| ORF 26 | Forward | GCGGATCCCATATG-CAGCTGATCGACTATTC | BamHI-NdeI | SEQ ID NO: 973 |
| | Reverse | CCCGCTCGAG-GACATCGGCGCGTTTT | XhoI | SEQ ID NO: 974 |
| ORF 27 | Forward | GGAATTCCATATGGCCATGG-AGACCTATTCTGTTTA | NdeI-NcoI | SEQ ID NO: 1168 |
| | Forward | CGGGATCC-CAGACCTATTCTGTTTATTTTAATC | BamHI | SEQ ID NO: 975 |
| | Reverse | CCCGCTCGAG-GGGTTCGATTAAATAACCAT | XhoI | SEQ ID NO: 976 |
| ORF 28 | Forward | GGAATTCCATATGGCCATGG-ACGGCTGTACGTTGATGT | NdeI-NcoI | SEQ ID NO: 977 |
| | Forward | CGGGATCC-AACGGCTGTACGTTGATG | BamHI | SEQ ID NO: 978 |
| | Reverse | CCCGCTCGAG-TTTGTCAGAGGAATTCGCG | XhoI | SEQ ID NO: 979 |
| ORF 29 | Forward | GCGGATCCCATATG-AACGGTTTGGATGCCCG | BamHI-NdeI | SEQ ID NO: 980 |
| | Forward | CGCGGATCCGCTAGC-AACGGTTTGGATGCCCG | BamHI-NheI | SEQ ID NO: 981 |
| | Reverse | CCCGCTCGAG-TTTGTCTAAGTTCCTGATATG | XhoI | SEQ ID NO: 982 |
| ORF 32 | Forward | CGCGGATCCCATATG-AATACTCCTCCTTTTG | BamHI-NdeI | SEQ ID NO: 983 |
| | Reverse | CCCGCTCGAG-GCGTATTTTTTGATGCTTTG | XhoI | SEQ ID NO: 984 |
| ORF 33 | Forward | GCGGATCCCATATG-ATTGATAGGGATCGTATG | BamHI-NdeI | SEQ ID NO: 985 |
| | Reverse | CCCGCTCGAG-TTGATCTTTCAAACGGCC | XhoI | SEQ ID NO: 986 |
| ORF 35 | Forward | GCGGATCCCATATG-TTCAGAGCTCAGCTT | BamHI-NdeI | SEQ ID NO: 987 |
| | Forward | CGCGGATCCGCTAGC-TTCAGAGCTCAGCTT | BamHI-NheI | SEQ ID NO: 988 |
| | Reverse | CCCGCTCGAG-AAACAGCCATTTGAGCGA | XhoI | SEQ ID NO: 989 |
| ORF 37 | Forward | GCGGATCCCATATG-GATGACGTATCGGATTTT | BamHI-NdeI | SEQ ID NO: 990 |
| | Reverse | CCCGCTCGAG-ATAGCCCGCTTTCAGG | XhoI | SEQ ID NO: 991 |
| ORF 58 | Forward | CGCGGATCCGCTAGC-TCCAACGCGAGTGGAT | BamHI-NheI | SEQ ID NO: 992 |
| | Reverse | CCCGCTCGAG-AGCATTGTCCAAGGGAC | XhoI | SEQ ID NO: 993 |
| ORF 65 | Forward | GGAATTCCATATGGCCATGG-TGCTGTATCTGAATCAAG | NdeI-NcoI | SEQ ID NO: 994 |
| | Forward | CGGGATCC-TTGCTGTATCTGAATCAAGG | BamHI | SEQ ID NO: 995 |
| | Reverse | CCCGCTCGAG-CCGCATCGGCAGACA | XhoI | SEQ ID NO: 996 |
| ORF 66 | Forward | GCGGATCCCATATG-TACGCATTTACCGCCG | BamHI-NdeI | SEQ ID NO: 997 |
| | Reverse | CCCGCTCGAG-TGGATTTTGCAGAGATGG | XhoI | SEQ ID NO: 998 |
| ORF 72 | Forward | CGCGGATCCCATATG-AATGCAGTAAAAATATCTGA | BamHI-NdeI | SEQ ID NO: 999 |
| | Reverse | CCCGCTCGAG-GCCTGAGACCTTTGCAA | XhoI | SEQ ID NO: 1000 |
| ORF 73 | Forward | GCGGATCCCATATG-AGATTTTCGGTATCGG | BamHI-NdeI | SEQ ID NO: 1001 |
| | Reverse | CCCGCTCGAG-TTCATCTTTTTCATGTTCG | XhoI | SEQ ID NO: 1002 |
| ORF 75 | Forward | GCGGATCCCATATG-TCTGTCTTTCAAACGGC | BamHI-NdeI | SEQ ID NO: 1003 |
| | Reverse | CCCGCTCGAG-TTTGTTTTGCAAGACAG | XhoI | SEQ ID NO: 1004 |
| ORF 76 | Forward | GATCAGCTAGCCATATG-AAACAGAAAAAACCGC | NheI-NdeI | SEQ ID NO: 1005 |
| | Reverse | CGGGATCC-TTACGGTTTGACACCGTT | BamHI | SEQ ID NO: 1006 |
| ORF 79 | Forward | GCGGATCCCATATG-GTTTCCGCCGCCG | BamHI-NdeI | SEQ ID NO: 1007 |
| | Reverse | CCCGCTCGAG-GTGCTGATGCGCTTCG | XhoI | SEQ ID NO: 1008 |
| ORF 83 | Forward | GCGGATCCCATATG-AAAACCCTGCTGCTGC | BamHI-NdeI | SEQ ID NO: 1009 |
| | Reverse | CCCGCTCGAG-GCCGCCTTTGCGGC | XhoI | SEQ ID NO: 1010 |
| ORF 84 | Forward | GCGGATCCCATATG-GCAGAGATCTGTTTG | BamHI-NdeI | SEQ ID NO: 1011 |
| | Reverse | CCCGCTCGAG-GTTTGCCGATCCGACCA | XhoI | SEQ ID NO: 1012 |
| ORF 85 | Forward | CGCGGATCCCATATG-GCGGTTTGGGGCGGA | BamHI-NdeI | SEQ ID NO: 1013 |
| | Reverse | CCCGCTCGAG-TCGGCGCGGCGGGC | XhoI | SEQ ID NO: 1014 |
| ORF 89 | Forward | GGAATTCCATATGGCCATGG-CCATACCTTCTTATCA | NdeI-NcoI | SEQ ID NO: 1015 |
| | Forward | CGGGATCC-GCCATACCTTCTTATCAGAG | BamHI | SEQ ID NO: 1016 |
| | Reverse | CCCGCTCGAG-TTTTTTGCGATTAGAAAAGC | XhoI | SEQ ID NO: 1017 |
| ORF 97 | Forward | GCGGATCCCATATG-CATCCTGCCAGCGAAC | BamHI-NdeI | SEQ ID NO: 1018 |
| | Reverse | CCCGCTCGAG-TTCGCCTACGGTTTTTG | XhoI | SEQ ID NO: 1019 |
| ORF 98 | Forward | GCGGATCCCATATG-ACGGTAACTGCGG | BamHI-NdeI | SEQ ID NO: 1020 |
| | Reverse | CCCGCTCGAG-TTGTTGTTCGGCAAATC | XhoI | SEQ ID NO: 1021 |
| ORF 100 | Forward | GCGGATCCCATATG-TCGGGCATTTACACCG | BamHI-NdeI | SEQ ID NO: 1022 |
| | Reverse | CCCGCTCGAG-ACGGGTTTCGGCGGAA | XhoI | SEQ ID NO: 1023 |

TABLE I-continued

PCR primers

| ORF | Primer | Sequence | Restriction sites | |
|---|---|---|---|---|
| ORF 101 | Forward | GCGGATCCCATATG-ATTTATCAAAGAAACCTC | BamHI-NdeI | SEQ ID NO: 1024 |
| | Reverse | CCCGCTCGAG-TTTTCCGCCTTTCAATGT | XhoI | SEQ ID NO: 1025 |
| ORF 102 | Forward | GCGGATCCCATATG-GCAGGGCTGTTTTACC | BamHI-NdeI | SEQ ID NO: 1026 |
| | Reverse | CCCGCTCGAG-AAACGGTTTGAACACGAC | XhoI | SEQ ID NO: 1027 |
| ORF 103 | Forward | GCGGATCCCATATG-AACCACGACATCAC | BamHI-NdeI | SEQ ID NO: 1028 |
| | Reverse | CCCGCTCGAG-CAGCCACAGGACGGC | XhoI | SEQ ID NO: 1029 |
| ORF 104 | Forward | GCGGATCCCATATG-ACGTGGGGAACGC | BamHI-NdeI | SEQ ID NO: 1030 |
| | Reverse | CCCGCTCGAG-GCGGCGTTTGAACGG | XhoI | SEQ ID NO: 1031 |
| ORF 105 | Forward | GCGGATCCCATATG-ACCAAATTTCAAACCCCTC | BamHI-NdeI | SEQ ID NO: 1032 |
| | Reverse | CCCGCTCGAG-TAAACGAATGCCGTCCAG | XhoI | SEQ ID NO: 1033 |
| ORF 106 | Forward | GCGGATCCCATATG-AGGATAACCGACGGCG | BamHI-NdeI | SEQ ID NO: 1034 |
| | Reverse | CCCGCTCGAG-TTTGTTCCCGATGATGTT | XhoI | SEQ ID NO: 1035 |
| ORF 109 | Forward | GCGGATCCCATATG-GAAGATTTATATATAATACTCG | BamHI-NdeI | SEQ ID NO: 1036 |
| | Reverse | CCCGCTCGAG-ATCAGCTTCGAACCGAAG | XhoI | SEQ ID NO: 1037 |
| ORF 110 | Forward | AAAGAATTC-ATGAGTAAATCCCGTAGATCTCCC | EcoRI | SEQ ID NO: 1038 |
| | Reverse | AAACTGCAG-GGAAAACCACATCCGCACTCTGCC | PstI | SEQ ID NO: 1039 |
| ORF 111 | Forward | AAAGAATTC-GCACCGCAAAAGGCAAAACCGCA | EcoRI | SEQ ID NO: 1040 |
| | Reverse | AAACTGCAG-TCTGCGCGTTTTCGGGCAGGGTGG | PstI | SEQ ID NO: 1041 |
| ORF 113 | Forward | AAAGAATTC-ATGAACAAAACCCTCTATCGTGTGATTTTCAACCG | EcoRI | SEQ ID NO: 1042 |
| | Reverse | AAACTGCAG-TTACGAATGCCTGCTTGCTCGACCGTACTG | PstI | SEQ ID NO: 1043 |
| ORF 115 | Forward | AAAGAATTC-TTGCTTGTGCAAACAGAAAAGACGG | EcoRI | SEQ ID NO: 1044 |
| | Reverse | AAAAAAGTCGAC-CTATTTTTTAGGGGCTTTTGCTTGTTTGAAAAGCCTGCC | SalI | SEQ ID NO: 1045 |
| ORF 119 | Forward | AAAGAATTC-TACAACATGTATCAGGAAAACCAATACCG | EcoRI | SEQ ID NO: 1046 |
| | Reverse | AAACTGCAG-TTATGAAAACAGGCGCAGGGCGGTTTTGCC | PstI | SEQ ID NO: 1047 |
| ORF 120 | Forward | AAAGAATTC-GCAAGGCTACCCCAATCCGCCGTG | EcoRI | SEQ ID NO: 1048 |
| | Reverse | AAACTGCAG-CGGTTTGGCTGCCTGGCCGTTGAT | PstI | SEQ ID NO: 1049 |
| ORF 121 | Forward | AAAGAATTC-GCCTTGGTCTGGCTGGTTTTCGC | EcoRI | SEQ ID NO: 1050 |
| | Reverse | AAACTGCAG-TCATCCGCCACCCCACCTCGGCCATCCATC | PstI | SEQ ID NO: 1051 |
| ORF 122 | Forward | AAAAAAGTCGAC-ATGTCTTACCGCGCAAGCAGTTCTCC | SalI | SEQ ID NO: 1052 |
| | Reverse | AAACTGCAG-TCAGGAACACAAACGATGACGAATATCCGTATC | PstI | SEQ ID NO: 1053 |
| ORF 125 | Forward | AAAGAATTC-GCGCTGTTTTTTGCGGCGGCGTAT | EcoRI | SEQ ID NO: 1054 |
| | Reverse | AAACTGCAG-CGCCGTTTCAAGACGAAAAAGTCG | PstI | SEQ ID NO: 1055 |
| ORF 126 | Forward | AAAGAATTC-GCGGAAACGGTCGAAG | EcoRI | SEQ ID NO: 1056 |
| | Reverse | AAACTGCAG-TTAATCTTGTCTTCCGATATAC | PstI | SEQ ID NO: 1057 |
| ORF 127 | Forward | AAAGAATTC-ATGACTGATAATCGGGGGTTTACG | EcoRI | SEQ ID NO: 1058 |
| | Reverse | AAAAAAGTCGAC-CTTAAGTAACTTGCAGTCCTTATC | SalI | SEQ ID NO: 1059 |
| ORF 128 | Forward | AAAGAATTC-ATGCAAGCTGTCCGCTACAGGCC | EcoRI | SEQ ID NO: 1060 |
| | Reverse | AAACTGCAG-CTATTGCAATGCGCCGCCGCGGGAATGTTTGAGCAGGCG | PstI | SEQ ID NO: 1061 |
| ORF 129 | Forward | AAAGAATTC-ATGGATTTTCGTTTGCACATTATTTACGAATACCG | EcoRI | SEQ ID NO: 1062 |
| | Reverse | AAACTGCAG-TTATTTTTTGATGAAATTTTGGGCGG | PstI | SEQ ID NO: 1063 |
| ORF 130 | Forward | AAAGAATTC-GCAGTACTTGCCATTCTCGGTGCG | EcoRI | SEQ ID NO: 1064 |
| | Reverse | AAACTGCAG-CTCCGGATCGTCTGTAAACGCATT | PstI | SEQ ID NO: 1065 |
| ORF 131 | Forward | GCGGATCCCATATG-GAAATTCGGGCAATAAAAT | BamHI-NdeI | SEQ ID NO: 1066 |
| | Reverse | CCCGCTCGAG-CCAGCGGACGCGTTC | XhoI | SEQ ID NO: 1067 |
| ORF 132 | Forward | GCGGATCCCATATG-AAAGAAGCGGGGTTTG | BamHI-NdeI | SEQ ID NO: 1068 |
| | Reverse | CCCGCTCGAG-CCAATCTGCCAGCCGT | XhoI | SEQ ID NO: 1069 |
| ORF 133 | Forward | CGCGGATCCCATATG-GAAGATGCAGGGCGCG | BamHI-NdeI | SEQ ID NO: 1071 |
| | Reverse | CCCGCTCGAG-AAACTTGTAGCTCATCGT | XhoI | SEQ ID NO: 1072 |
| ORF 134 | Forward | GCGGATCCCATATG-TCTGTGCAAGCAGTATTG | BamHI-NdeI | SEQ ID NO: 1073 |
| | Reverse | CCCGCTCGAG-ATCCTGTGCCAATGCG | XhoI | SEQ ID NO: 1074 |

TABLE I-continued

PCR primers

| ORF | Primer | Sequence | Restriction sites | |
|---|---|---|---|---|
| ORF 135 | Forward | GC<u>GGATCCCATATG</u>-CCGTCTGAAAAAGCTTT | BamHI-NdeI | SEQ ID NO: 1075 |
| | Reverse | CCCG<u>CTCGAG</u>-AAATACCGCTGAGGATG | XhoI | SEQ ID NO: 1076 |
| ORF 136 | Forward | CGC<u>GGATCCGCTAGC</u>-ATGAAGCGGCGTATAGCC | BamHI-NheI | SEQ ID NO: 1077 |
| | Reverse | CCCG<u>CTCGAG</u>-TTCCGAATATTTGGAACTTTT | XhoI | SEQ ID NO: 1078 |
| ORF 137 | Forward | CGC<u>GGATCCCATATG</u>-GGCACGGCGGGAAATA | BamHI-NdeI | SEQ ID NO: 1079 |
| | Reverse | CCCG<u>CTCGAG</u>-ATAACGGTATGCCGCC | XhoI | SEQ ID NO: 1080 |
| ORF 138 | Forward | GC<u>GGATCCCATATG</u>-TTTCGTTTACAATTCAGGC | BamHI-NdeI | SEQ ID NO: 1081 |
| | Reverse | CCCG<u>CTCGAG</u>-CGGCGTTTTATAGCGG | XhoI | SEQ ID NO: 1082 |
| ORF 139 | Forward | GC<u>GGATCCCATATG</u>-GCTTTTTTGGCGGTAATG | BamHI-NdeI | SEQ ID NO: 1083 |
| | Reverse | CCCG<u>CTCGAG</u>-TAACGTTTCCGTGCGTTT | XhoI | SEQ ID NO: 1084 |
| ORF 140 | Forward | GC<u>GGATCCCATATG</u>-TTGCCCACAGGCAGC | BamHI-NdeI | SEQ ID NO: 1085 |
| | Reverse | CCCG<u>CTCGAG</u>-GACGATGGCAAACAGC | XhoI | SEQ ID NO: 1086 |
| ORF 141 | Forward | GC<u>GGATCCCATATG</u>-CCGTCTGAAGCAGTCT | BamHI-NdeI | SEQ ID NO: 1087 |
| | Reverse | CCCG<u>CTCGAG</u>-ATCTGTTGTTTTTAAAATATT | XhoI | SEQ ID NO: 1088 |
| ORF 142 | Forward | GC<u>GGATCCCATATG</u>-GATAATTCTGGTAGTGAAG | BamHI-NdeI | SEQ ID NO: 1089 |
| | Reverse | CCCG<u>CTCGAG</u>-AAACGTATAGCCTACCT | XhoI | SEQ ID NO: 1090 |
| ORF 143 | Forward | GC<u>GGATCCCATATG</u>-GATACCGCTTTGAACCT | BamHI-NdeI | SEQ ID NO: 1091 |
| | Reverse | CCCG<u>CTCGAG</u>-AATGGCTTCCGCAATATG | XhoI | SEQ ID NO: 1092 |
| ORF 144 | Forward | GC<u>GGATCCCATATG</u>-ACCTTTTTACAACGTTTGC | BamHI-NdeI | SEQ ID NO: 1093 |
| | Reverse | CCCG<u>CTCGAG</u>-AGATTGTTGTTGTTTTTTCG | XhoI | SEQ ID NO: 1094 |
| ORF 147 | Forward | GC<u>GGATCCCATATG</u>-TCTGTCTTTCAAACGGC | BamHI-NdeI | SEQ ID NO: 1095 |
| | Reverse | CCCG<u>CTCGAG</u>-TTTGTTTTTGCAAGACAG | XoI | SEQ ID NO: 1096 |

NB:

restriction sites are underlined for ORFs 110-130, where the ORF itself carries an EcoRI site (e.g. ORF122), a SalI site was used in the forward primer instead. Similarly, where the ORF carries a PstI site (e.g. ORFs 115 and 127), a SalI site was used in the reverse primer.

TABLE II

Summary of cloning, expression and purification

| ORF | PCR/ cloning | His-fusion expression | GST-fusion expression | Purification |
|---|---|---|---|---|
| orf 1 | + | + | + | His-fusion |
| orf 2 | + | + | + | GST-fusion |
| orf 2.1 | + | n.d. | + | GST-fusion |
| orf 4 | + | + | + | His-fusion |
| orf 5 | + | n.d. | + | GST-fusion |
| orf 6 | + | + | + | GST-fusion |
| orf 7 | + | + | + | GST-fusion |
| orf 8 | + | n.d. | n.d. | |
| orf 9 | + | + | + | GST-fusion |
| orf 10 | + | n.d. | n.d. | |
| orf 11 | + | n.d. | n.d. | |
| orf 13 | + | n.d. | + | GST-fusion |
| orf 15 | + | + | + | GST-fusion |
| orf 17 | + | n.d. | n.d. | |
| orf 18 | + | n.d. | n.d. | |
| orf 19 | + | n.d. | n.d. | |
| orf 20 | + | n.d. | n.d. | |
| orf 22 | + | + | + | GST-fusion |
| orf 23 | + | + | + | His-fusion |
| orf 24 | + | n.d. | n.d. | |
| orf 25 | + | + | + | His-fusion |

TABLE II-continued

Summary of cloning, expression and purification

| ORF | PCR/ cloning | His-fusion expression | GST-fusion expression | Purification |
|---|---|---|---|---|
| orf 26 | + | n.d. | n.d. | |
| orf 27 | + | + | + | GST-fusion |
| orf 28 | + | + | + | GST-fusion |
| orf 29 | + | n.d. | n.d. | |
| orf 32 | + | + | + | His-fusion |
| orf 33 | + | n.d. | n.d. | |
| orf 35 | + | n.d. | n.d. | |
| orf 37 | + | + | + | GST-fusion |
| orf 58 | + | n.d. | n.d. | |
| orf 65 | + | n.d. | n.d. | |
| orf 66 | + | n.d. | n.d. | |
| orf 72 | + | + | n.d. | His-fusion |
| orf 73 | + | n.d. | + | n.d. |
| orf 75 | + | n.d. | n.d. | |
| orf 76 | + | + | n.d. | His-fusion |
| orf 79 | + | + | n.d. | His-fusion |
| orf 83 | + | n.d. | + | n.d. |
| orf 84 | + | n.d. | n.d. | |
| orf 85 | + | n.d. | + | GST-fusion |
| orf 89 | + | n.d. | + | GST-fusion |
| orf 97 | + | + | + | GST-fusion |
| orf 98 | + | n.d. | n.d. | |
| orf 100 | + | n.d. | n.d. | |
| orf 101 | + | n.d. | n.d. | |
| orf 102 | + | n.d. | n.d. | |
| orf 103 | + | n.d. | n.d. | |
| orf 104 | + | n.d. | n.d. | |
| orf 105 | + | n.d. | n.d. | |
| orf 106 | + | + | + | His-fusion |
| orf 109 | + | n.d. | n.d. | |

TABLE II-continued

Summary of cloning, expression and purification

| ORF | PCR/cloning | His-fusion expression | GST-fusion expression | Purification |
|---|---|---|---|---|
| orf 110 | + | n.d. | n.d. | |
| orf 111 | + | + | n.d. | His-fusion |
| orf 113 | + | + | n.d. | His-fusion |
| orf 115 | n.d. | n.d. | n.d. | |
| orf 119 | + | + | n.d. | His-fusion |
| orf 120 | + | + | n.d. | His-fusion |
| orf 121 | + | n.d. | n.d. | |
| orf 122 | + | + | n.d. | His-fusion |
| orf 125 | + | + | n.d. | His-fusion |
| orf 126 | + | + | n.d. | His-fusion |
| orf 127 | + | + | n.d. | His-fusion |
| orf 128 | + | n.d. | n.d. | |
| orf 129 | + | + | n.d. | His-fusion |
| orf 130 | + | n.d. | n.d. | |
| orf 131 | + | + | + | n.d. |
| orf 132 | + | + | + | His-fusion |
| orf 133 | + | n.d. | + | GST-fusion |
| orf 134 | + | n.d. | n.d. | |
| orf 135 | + | n.d. | n.d. | |
| orf 136 | + | n.d. | n.d. | |
| orf 137 | + | n.d. | + | GST-fusion |
| orf 138 | + | n.d. | + | GST-fusion |
| orf 139 | + | n.d. | n.d. | |
| orf 140 | + | n.d. | n.d. | |
| orf 141 | + | n.d. | n.d. | |
| orf 142 | + | n.d. | n.d. | |
| orf 143 | + | n.d. | n.d. | |
| orf 144 | + | n.d. | + | n.d. |
| orf 147 | + | n.d. | n.d. | |

SEQUENCE LISTING (1168 sequences)

SEQ ID NO: 1 - DNA, 502 bp, Neisseria meningitidis
  misc_feature (66)..(66): N= Unknown
  misc_feature (483)..(483): N= Unknown
atgaaacagacagtcaaatgcttgccgccgccctgattgccttgggcttgaaccgaccggtgtggncggatgacgtatcggattttcgggaaaacttgcagcggcagcacagggaaatgcagcagcccaatacaatttgggcgcaatgtattacaaaggacgcgcgtgcgccgggatgatgctgaagcggtcagatggtatcggcagccggcggaacaggggttagcccaagcccaatacaatttgggctggatgtatgccaacgggcgcgcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagancgcgcgtgcgccaagaccg

SEQ ID NO: 2 - protein, 168 aa, Neisseria meningitidis
  misc_feature (6)..(6): Xaa= any amino acid
  misc_feature (23)..(23): Xaa= any amino acid
  misc_feature (34)..(34): Xaa= any amino acid
  misc_feature (52)..(52): Xaa= any amino acid
  misc_feature (92)..(92): Xaa= any amino acid
  misc_feature (163)..(163): Xaa= any amino acid
MKQTVXMLAAALIALGLNRPVWXDDVSDFRENLXAAAQGNAAAQYNLGAMYXQRTRVRRDDAEAVRWYRQPAEQGLAQAQYNLGWMYANGRXVRQDDTEAVRWYRQAAAQGVVQAQYNLGVIYAEGRGVRQDDVEAVRWFRQAAAQGVAQAQNNLGVMYAERXRVRQD

SEQ ID NO: 3 - DNA, 597 bp, Neisseria meningitidis
atgaaacagacagtcaaatggcttgccgccgccctgattgccttgggcttgaaccgagcggtgtgggcggatgacgtatcggattttcgggaaaacttgcaggcggcagcacagggaaatgcagcagcccaatacaatttgggcgcaatgtattacaaaggacgcggcgtgcgccgggatgatgctgaagcggtcagatggtatcggcaggcggcggaacaggggttagcccaagcccaatacaatttgggctggatgtatgccaacgggcgcggcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagacgcggcgtgcgccaagaccgcgcccttgcacaagaatggtttggcaaggcttgtcaaaacggagaccaagacggctgcgacaatgaccaacgcctgaaggcgggttattga

SEQ ID NO: 4 - protein, 198 aa, Neisseria meningitidis
MKQTVKWLAAALIALGLNRAVWADDVSDFRENLQAAAQGNAAAQYNLGAMYYKGRGVRRDDAEAVRWYRQAAEQGLAQAQYNLGWMYANGRGVRQDDTEAVRWYRQAAAQGVVQAQYNLGVIYAEGRGVRQDDVEAVRWFRQAAAQGVAQAQNNLGVMYAERRGVRQDRALAQEWFGKACQNGDQDGCDNDQRLKAGY

SEQ ID NO: 5 - DNA, 273 bp, Neisseria meningitidis
atgaaacagacagtcaaatggcttgccgccgccctgattgccttgggcttgaaccaagcggtgtgggcggatgacgtatcggattttcgggaaaacttgcaggcggcagcacagggaaatgcagcagcccaaaacaatttgggcgtgatgtatgccgaaagacgcggcgtgcgccaagaccgcgcccttgcacaagaatggcttggcaaggcttgtcaaaacggataccaagacagctgcgacaatgaccaacgcctgaaagcgggttattga

SEQ ID NO: 6 - protein, 90 aa, Neisseria meningitidis
MKQTVKWLAAALIALGLNQAVWADDVSDFRENLQAAAQGNAAAQNNLGVMYAERRGVRQDRALAQEWLGKACQNGYQDSCDNDQRLKAGY

SEQ ID NO: 7 - DNA, 381 bp, Neisseria gonorrhoeae
atgaaacagacagtcaaatggcttgccgccgccctgattgccttgggcttgaaccaagcggtgtgggcgggtgacgtatcggattttcgggaaaacttgcaggcggcagaacagggaaatgcagcagcccaattcaatttgggcgtgatgtatgaaaatggacaaggagttcgtcaagattatgtacaggcagtgcagtggtatcgcaaggcttcagaacaaggggatgcccaagcccaatacaatttgggcttgatgtattacgatggacgcggcgtgcgccaagaccttgcgctcgctcaacaatggcttggcaaggcttgtcaaaacggagaccaaaacagctgcgacaatgaccaacgcctgaaggcgggttattaa

SEQ ID NO: 8 - protein, 126 aa, Neisseria meningitidis
MKQTVKWLAAALIALGLNQAVWAGDVSDFRENLQAAEQGNAAAQFNLGVMYENGQGVRQDYVQAVQWYRKASEQGDAQAQYNLGLMYYDGRGVRQDLALAQQWLGKACQNGDQNSCDNDQRLKAGY

SEQ ID NO: 9 - DNA, 357 bp, Neisseria meningitidis
ttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcsggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 10 - protein, 118 aa, Neisseria meningitidis
FGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 11 - DNA, 858 bp, Neisseria meningitidis
attttgatatacctcatccgcaagaatctaggttcgcccgtcttcttctttcaggaacgccccggaaaggacggaaaaccttttaaaatggtcaaattccgttccatgcgcgacggcttgtattcagacggcattccgctgcccgacggagaacgcctgacaccgttcggcaaaaaactgcgtgccgccagtwtggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaacaaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgtactggttcatccggacgcgaccgtctcgccttctgcaacagtcggacaaggcagcgtcgttatggcgaaagcggtcg

SEQ ID NO: 12 - protein, 286 aa, Neisseria meningitidis
  misc_feature (65)..(65): Xaa= any amino acid
  misc_feature (165)..(165): Xaa= any amino acid
ILIYLIRKNLGSPVFFFQERPGKDGKPFKMVKFRSMRDGLYSDGIPLPDGERLTPFGKKLRAASXDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEXTMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAV

SEQ ID NO: 13 - DNA, 1242 bp, Neisseria meningitidis
atgagtaaattcttcaaacgcctgtttgacattgttgcctccgcctcgggactgattttcctctcgccagtatttttgattttgatatacctcatccgcaagaatctaggttcgcccgtcttcttctttcaggaacgccccggaaaggacggaaaaccttttaaaatggtcaaattccgttccatgcgcgacgcgcttgattcagacggcattccgctgcccgacggagaacgcctgacaccgttcggcaaaaaactgcgtgccgccagtttggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaagccaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgttctggttcatccggacgcgaccgtctcgccttctgcaacagtcggacaaggcagcgtcgttatggcgaaagccgtcgtacaggcaggcagcgtattgaaagacggcgtgattgtgaacactgccgccaccgtcgatcacgactgcctgcttaacgctttcgtccacatcagcccaggcgcgcacctgtcgggcaacacgcatatcggcgaagaaagctggataggcacgggcgcgtgcagccgccagcagatccgtatcggcagccgcgcaaccattggagcgggcgcagtcgtcgtacgcgacgtttcagacggcatgaccgtcgcgggcaatccggcaaagccgctgccgcgcaaaaaccccgagacctcgacagcataa

SEQ ID NO: 14 - protein, 413 aa, Neisseria meningitidis
MSKFFKRLFDIVASASGLIFLSPVFLILIYLIRKNLGSPVFFFQERPGKDGKPFKMVKFRSMRDALDSDGIPLPDGERLTPFGKKLRAASLDELPELWNILKGEMSLVGPRPLLMQYLPLYDNFQNRRHEMKPGITGWAQVNGRNALSWDEKFACDVWYIDHFSLCLDIKILLLTVKKVLIKEGISAQGEATMPPFTGKRKLAVVGAGGHGKVVADLAAALGRYREIVFLDDRAQGSVNGFSVIGTTLLLENSLSPEQYDVAVAVGNNRIRRQIAEKAAALGFALPVLVHPDATVSPSATVGQGSVVMAKAVVQAGSVLKDGVIVNTAATVDHDCLLNAFVHISPGAHLSGNTHIGEESWIGTGACSRQQIRIGSRATIGAGAVVVRDVSDGMTVAGNPAKPLPRKNPETSTA

SEQ ID NO: 15 - DNA, 1242 bp, Neisseria meningitidis
atgagtaaattcttcaaacgcctgtttgacattgttgcctccgcctcgggactgattttcctctcgccagtatttttgattttgatatacctcatccgcaagaatctgggttcgcccgtcttcttctttcaggaacgccccggaaaggacggaaaaccttttaaaatggtcaaattccgttccatgcacgacgcgcttgattcagacggcattctgctgcccgacggagaacgcctgacaccgttcggcaaaaaactgcgtgccgccagtttggacgaactgcccgaactgtggaacgtcctcaaaggcgacatgagcctggtcggcccccgcccgctgctgatgcaatatctgccgctgtacgacaacttccaaaaccgccgccacgaaatgaaaccgggcattaccggctgggcgcaggtcaacgggcgcaacgcgctttcgtgggacgaacgcttcgcatgcgacatctggtatatcgaccacttcagcctgtgcctcgacatcaaaatcctactgctgacggttaaaaaagtattaatcaaagaagggatttccgcacagggcgaagccaccatgccccctttcacaggaaaacgcaaacttgccgtcgtcggtgcgggcggacacggcaaagtcgttgccgagcttgccgccgcactcggcacatacggcgaaatcgtttttctggacgaccgcgtccaaggcagcgtcaacggcttccccgtcatcggcacgacgctgctgcttgaaaacagtttatcgcccgaacaattcgacatcgccgtcgccgtcggcaacaaccgcatccgccgccaaatcgccgaaaaagccgccgcgctcggcttcgccctgcccgtcctgattcatccggactcgaccgtctcgccttctgcaacagtcggacaaggcggcgtcgttatggcgaaagccgtcgtacaggctgacagcgtattgaaagacggcgtaattgtgaacactgccgccaccgtcgatcacgattgcctgcttgatgctttcgtccacatcagcccgggcgcgcacctgtcgggcaacacgcgtatcggcgaagaaagctggataggcacaggcgcgtgcagccgccagcagatccgtatcggcagccgcgcaaccattggagcgggcgcagtcgtcgtgcgcgacgtttcagacggcatgaccgtcgcgggcaacccggcaaaaccattggcaggcaaaaataccgagaccctgcggtcgtaa

SEQ ID NO: 16 - protein, 413 aa, Neisseria meningitidis
MSKFFKRLFDIVASASGLIFLSPVFLILIYLIRKNLGSPVFFFQERPGKDGKPFKMVKFRSMHDALDSDGILLPDGERLTPFGKKLRAASLDELPELWNVLKGDMSLVGPRPLLMQYLPLYDNFQNRRHEMKPGITGWAQVNGRNALSWDERFACDIWYIDHFSLCLDIKILLLTVKKVLIKEGISAQGEATMPPFTGKRKLAVVGAGGHGKVVAELAAALGTYGEIVFLDDRVQGSVNGFPVIGTTLLLENSLSPEQFDIAVAVGNNRIRRQIAEKAAALGFALPVLIHPDSTVSPSATVGQGGVVMAKAVVQADSVLKDGVIVNTAATVDHDCLLDAFVHISPGAHLSGNTRIGEESWIGTGACSRQQIRIGSRATIGAGAVVVRDVSDGMTVAGNPAKPLAGKNTETLRS

SEQ ID NO: 17 - DNA, 1242 bp, Neisseria gonorrhoeae
atgagtaaagccgtcaaacgcctgttcgacatcatcgcatccgcatcggggctgattgtcctgtcgcccgtgtttttggttttaatatacctcatccgcaaaaacttaggttcgcccgtcttcttcattcgggaacgccccggaaaggacggaaaaccttttaaaatggtcaaattccgttccatgcgcgacgcgcttgattcagacggcattccgctgcccgatagcgaacgcctgaccgatttcggcaaaaaattacgcgccaccagtttggacgaacttcctgaattatggaatgtcctcaaaggcgagatgagcctggtcggcccccgcccgcttttgatgcagtatctgccgctttacaacaaatttcaaaaccgccgccacgaaatgaaaccgggcattaccggctgggcgcaggtcaacgggcgcaacgcgctttcgtgggacgaaaagttctcctgcgatgtttggtacaccgacaatttcagcttttggctggatatgaaaatcctgtttctgacagtcaaaaaagtcttgattaaagaaggcatttcggcgcaaggggaagccaccatgccccctttcgcggggaatcgcaaactcgccgttatcggcgcgggcggacacggcaaagtcgttgccgagcttgccgccgcactcggcacatacggcgaaatcgtttttctggacgaccgcacccaaggcagcgtcaacggcttccccgtcatcggcacgacgctgctgcttgaaaacagtttatcgcccgaacaattcgacatcaccgtcgccgtcggcaacaaccgcatccgccgccaaatcaccgaaaacgccgccgcgctcggcttcaaactgcccgttctgattcatcccgacgcgaccgtctcgccttctgcaataatcggacaaggcagcgtcgtaatggcgaaagccgtcgtacaggccggcagcgtattgaaagacggcgtgattgtgaacactgccgccaccgtcgatcacgactgcctgcttgacgctttcgtccacatcagcccgggcgcgcacctgtcgggcaacacgcgtatcggcgaagaaagccggataggcacgggcgcgtgcagccgccagcagacaaccgtcggcagcggggttaccgccggtgcaggggcggttatcgtatgcgacatcccggacggcatgaccgtcgcgggcaacccggcaaagccccttacgggcaaaaaccccaagaccgggacggcataa

SEQ ID NO: 18 - protein, 413 aa, Neisseria gonorrhoeae
MSKAVKRLFDIIASASGLIVLSPVFLVLIYLIRKNLGSPVFFIRERPGKDGKPFKMVKFRSMRDALDSDGIPLPDSERLTDFGKKLRATSLDELPELWNVLKGEMSLVGPRPLLMQYLPLYNKFQNRRHEMKPGITGWAQVNGRNALSWDEKFSCDVWYTDNFSFWLDMKILFLTVKKVLIKEGISAQGEATMPPFAGNRKLAVIGAGGHGKVVAELAAALGTYGEIVFLDDRTQGSVNGFPVIGTTLLLENSLSPEQFDITVAVGNNRIRRQITENAAALGFKLPVLIHPDATVSPSAIIGQGSVVMAKAVVQAGSVLKDGVIVNTAATVDHDCLLDAFVHISPGAHLSGNTRIGEESRIGTGACSRQQTTVGSGVTAGAGAVIVCDIPDGMTVAGNPAKPLTGKNPKTGTA

SEQ ID NO: 19 - DNA, 394 bp, Neisseria meningitidis
aaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttcagacacgtggcgcatccatgcagctaccgaaatcgaagacatcaacaccttcttcggcacggaatacagcatcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttag

SEQ ID NO: 20 - protein, 131 aa, Neisseria meningitidis
  misc_feature (79)..(79): Xaa= any amino acid
  misc_feature (125)..(125): Xaa= any amino acid
NHMAIVIDEYGGTSGLVTFEDIIEQIVGEIEDEFDEDDSADNIHAVSSDTWRIHAATEIEDINTFFGTEYSIEEADTIXRPGHSRVGTSARARRKSPYRRFAVHRRTRRQPPPAYADGDPREVSXRRFCTV

SEQ ID NO: 21 - DNA, 900 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttccgaacgctggcgcatccatgcagctaccgaaatcgaagacatcaacaccttcttcggcacggaatacagcagcgaagaagccgacaccattcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttaggatgacggtacgggcgttttctgtttcaatccgccccatccgccaaacataa

SEQ ID NO: 22 - protein, 299 aa, Neisseria meningitidis
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSSEEADTIRPGHSRVGTSARARRKSPYRRFAVHRRTRRQPPPAYADGDPREVSTAVSAQFRMTVRAFSVSIRPIRQT

SEQ ID NO: 23 - DNA, 903 bp, Neisseria meningitidis
  misc_feature (33)..(34): N= Unknown
  misc_feature (698)..(698): N= Unknown
  misc_feature (717)..(717): N= Unknown
  misc_feature (746)..(746): N= Unknown
  misc_feature (756)..(757): N= Unknown
  misc_feature (763)..(763): N= Unknown
  misc_feature (769)..(769): N= Unknown
  misc_feature (776)..(776): N= Unknown
  misc_feature (781)..(781): N= Unknown
  misc_feature (897)..(897): N= Unknown
atggacggcgcacaaccgaaaacaaattttttnnaacgcctgattgcccgactcgcccgcgaacccgattccgccgaagacgtattgaccctgttgcgccaagcgcacgaacaggaagtatttgatgcggatacgcttttaagattggaaaaagtcctcgatttttctgatttggaagtgcgcgacgcgatgattacgcgcagccgtatgaacgttttaaaagaaaacgacagcatcgaacgcatcaccgcctacgttatcgataccgcccattcgcgcttccccgtcatcggtgaagacaaagacgaagttttgggtattttgcacgccaaagacctgctcaaatatatgttcaaccccgagcagttccacctcaaatcgatattgcgccctgccgtcttcgtccccgaaggcaaatcgctgaccgcccttttaaaagagttccgcgaacagcgcaaccatatggcaatcgtcatcgacgaatacggcggcacgtcgggtttggtaacttttgaagacatcatcgagcaaatcgtcggcgacatcgaagatgagtttgacgaagacgaaagcgcggacaacatccacgccgtttccgccgaacgctggcgcatccacgcggctaccgaaatcgaagacatcaacgcctttttcggcacggaatacagcagcgaagaagccgacaccatcggcggccntggtcattcaggaattggnacacctgcccgtgcgcggcgaaaaagtcnttatcggcgnnttgcanttcacngtcgccngcgcngacaaccgccgcctgcatacgctgatggcgacccgcgtgaagtaagctccgccgtttctgtacagtttaggatgacggtacgggcgttttctgtttcaatccgccccatccgccanacataa

SEQ ID NO: 24 - protein, 300 aa, Neisseria meningitidis
  misc_feature (11)..(12): Xaa= any amino acid
  misc_feature (233)..(233): Xaa= any amino acid
  misc_feature (249)..(249): Xaa= any amino acid
  misc_feature (253)..(253): Xaa= any amino acid
  misc_feature (255)..(255): Xaa= any amino acid
  misc_feature (257)..(257): Xaa= any amino acid
  misc_feature (259)..(259): Xaa= any amino acid
  misc_feature (261)..(261): Xaa= any amino acid
  misc_feature (299)..(299): Xaa= any amino acid
MDGAQPKTNFXXRLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGXGHSGIGTPARARRKSXYRRXAXHXRXRXQPPPAYADGDPREVSSAVSVQFRMTVRAFSVSIRPIRXT

SEQ ID NO: 25 - DNA, 8 bp, Neisseria gonorrhoeae
  misc_feature (1)..(8): N= Unknown
nnnnnnnn

SEQ ID NO: 26 - protein, 287 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPHRRFCTV

SEQ ID NO: 27 - DNA, 915 bp, Neisseria gonorrhoeae
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacgacatccactccgtttccgccgaacgctggcgcatccacgcggctaccgaaatcgaagacatcaacgcctttttcggtacggaatacggcagcgaagaagccgacaccatccggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaagtaagcagagcctgcccgaccgccgtttctgcacagtttaggatgacggtacggtcgttttctgtttcaatccgccccatccgccaaacataa

SEQ ID NO: 28 - protein, 304 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIRRLGHSGIGTPARARRKSPYRRFAVHRRPRRQPPPAHADGDPREVSRACPTAVSAQFRMTVRSFSVSIRPIRQT

SEQ ID NO: 29 - DNA, 563 bp, Neisseria meningitidis
atgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaagggcgatgcaacgccgcctgaatgagggcatgggaaagcaggcaggacgggctgccttataaaaacccttatgaaatgctgattatggcgarcctggtcgaaaaggaaacagggcatgaagccgascscgaccatgtcgcttccgtcttcgtcaaccgcctgaaaatcggtatgcgcctgcaaaccgasscgtccgtgatttacggcatgggtgcggcatacaagggcaaaatccgtaaagccgacctgcgccgcgacacgccgtacaacacctacacgcgcggcggtctgccgccaaccccgattgcgctgccc

SEQ ID NO: 30 - protein, 187 aa, Neisseria meningitidis
  misc_feature (113)..(113): Xaa= any amin acid
  misc_feature (124)..(125): Xaa= any amin acid
  misc_feature (145)..(146): Xaa= any amin acid
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMAXLVEKETGHEAXXDHVASVFVNRLKIGMRLQTXXSVIYGMGAAYKGKIRKADLRRDTPYNTYTRGGLPPTPIALP

SEQ ID NO: 31 - DNA, 996 bp, Neisseria meningitidis
atgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataa

SEQ ID NO: 32 - protein, 331 aa, Neisseria meningitidis
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWESRQDGLPYKNPYEMLIMASLVEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 33 - DNA, 996 bp, Neisseria meningitidis
atgttgagaaaattgttgaaatggtctgccgtttttttgaccgtatcggcagccgttttcgccgcgctgcttttcgtccctaaagacaacggcagggcatacaggattaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagactgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcgaacacgacaccaaaggctggagcaatgaaaaactgatggcggaagttgcccctgatgccttcagcggcaatcctgaagggcagtttttccccgacagctacgaaatcgatgcgggcggcagcgatttacggatttaccaaatcgcctacaaggcgatgcaacgccgactgaatgaggcatgggaaagcaggcaggacgggctgccttataaaaacccttatgaaatgctgattatggcgagcctgatcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgatcgcgctgcccggcaaggcggcactcgatgccgccgcccatccgtccggtgaaaaatacctgtatttcgtgtccaaaatggacggtacgggcttgagccagttcagccatgatttgaccgaacacaacgccgccgttcgcaaatatattttgaaaaaataa

SEQ ID NO: 34 - protein, 331 aa, Neisseria meningitidis
MLRKLLKWSAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIEHDTKGWSNEKLMAEVAPDAFSGNPEGQFFPDSYEIDAGGSDLRIYQIAYKAMQRRLNEAWESRQDGLPYKNPYEMLIMASLIEKETGHEADRDHVASVFVNRLKIGMRLQTDPSVIYGMGAAYKGKIRKADLRRDTPYNTYTRGGLPPTPIALPGKAALDAAAHPSGEKYLYFVSKMDGTGLSQFSHDLTEHNAAVRKYILKK

SEQ ID NO: 35 - DNA, 8 bp, Neisseria gonorrhoeae
  misc_feature (1)..(8): N= Unknown
nnnnnnnn

SEQ ID NO: 36 - protein, 236 aa, Neisseria gonorrhoeae
MRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 37 - DNA, 897 bp, Neisseria gonorrhoeae
taccgaatcaagattgccaaaaatcagggtatttcgtcggtcggcaggaaacttgccgaagaccgcatcgtgttcagcaggcatgttttgacagcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagttttttcccgacagctacgaaatcgatgcgggcggcagcgatttgcagatttaccaaaccgcctacaaggcgatgcaacgccgcctgaacgaggcatgggcaggcaggcaggacgggctgccttataaaaacccttatgaaatgctgattatggcgagcctgatcgaaaaggaaacggggcatgaggccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctatacgggcgggggcttgccgccaacccggattgcgctgcccggcaaggcggcaatggatgccgccgcccacccgtccggcgaaaaatacctgtatttcgtgtccaaaatggacggcacgggcttgagccagttcagccatgatttgaccgaacacaacgccgccgtccgcaaatatattttgaaaaaataa

SEQ ID NO: 38 - protein, 298 aa, Neisseria gonorrhoeae
YRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTGGGLPPTRIALPGKAAMDAAAHPSGEKYLYFVSKMDGTGLSQFSHDLTEHNAAVRKYILKK

SEQ ID NO: 39 - DNA, 498 bp, Neisseria meningitidis
cgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggacgggaagaagtgctggctcaggcggacgaaggacag

SEQ ID NO: 40 - protein, 166 aa, Neisseria meningitidis
RFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGREEVLAQADEGQ

SEQ ID NO: 41 - DNA, 1845 bp, Neisseria meningitidis
atgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 42 - protein, 614 aa, Neisseria meningitidis
MLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 43 - DNA, 1839 bp, Neisseria meningitidis
  misc_feature (217)..(217): N= Unknown
  misc_feature (333)..(333): N= Unknown
  misc_feature (478)..(478): N= Unknown
  misc_feature (499)..(499): N= Unknown
  misc_feature (653)..(653): N= Unknown
  misc_feature (958)..(958): N= Unknown
  misc_feature (1165)..(1165): N= Unknown
  misc_feature (1609)..(1609): N= Unknown
atgttacccgcccgtttcaccattttatctgtgctcgcggcagccctgcttgccgggcaggcgtatgccgccggcgcggcggatgcgaagccgccgaaggaagtcggaaaggttttcagaaagcagcagcgttacagcgaggaagaaatcaaaaacgaacgcgcacggcttgcggcagtgggcgagcgggttaatcagatatttacgttgctgggangggaaaccgccttgcaaaaggggcaggcgggaacggctctggcaacctatatgctgatgttggaacgcacaaaatcccccgaagtcgccgaacgcgccttggaaatggccgtgtcnctgaacgcgtttgaacaggcggaaatgatttatcagaaatggcggcagattgagcctataccgggtaaggcgcaaaaacgggcggggtggctgcggaacgtgctgagggaaagaggaaatcagcatctagacggactggaagaantgctggctcaggcggacgaangacagaaccgcagggtgtttttattgttggcacaagccgccgtgcaacaggacgggttggcgcaaaaagcatcgaaagcggttcgccgcgcggcgttgagatatgaacatctgcccgaagcggcggttgccgatgtggtgttcagcgtacaggnacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaangtgcttccgttatcgacggctacgccgaaaaggcatacggcagggggacgggggaacagcggggcagggcggcaatgacggcggcgatgatatatgccgaccgaagggattacaccaaagtcaggcagtggttgaaaaaagtgtccgcgccggaatacctgttcgacaaaggtgtgctggcggctgcggcggctgtcgagttggacngcggcagggcggctttgcggcagatcggcagggtgcggaaacttcccgaacagcaggggcggtattttacggcagacaatttgtccaaaatacagatgttcgccctgtcgaagctgcccgacaaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctttccgattccaaacgtttggacgaaggcttcgccctgcttcagacggcataccaaatcaacccggacgataccgctgtcaacgacagcataggctgggcgtattacctgaaangcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 44 - protein, 612 aa, Neisseria meningitidis
  misc_feature (73)..(73): Xaa= any amino acid
  misc_feature (160)..(160): Xaa= any amino acid
  misc_feature (167)..(167): Xaa= any amino acid
  misc_feature (218)..(218): Xaa= any amino acid
  misc_feature (320)..(320): Xaa= any amino acid
  misc_feature (389)..(389): Xaa= any amino acid
  misc_feature (537)..(537): Xaa= any amino acid
MLPARFTILSVLAAALLAGQAYAAGAADAKPPKEVGKVFRKQQRYSEEEIKNERARLAAVGERVNQIFTLLGXETALQKGQAGTALATYMLMLERTKSPEVAERALEMAVSLNAFEQAEMIYQKWRQIEPIPGKAQKRAGWLRNVLRERGNQHLDGLEEXLAQADEXQNRRVFLLLAQAAVQQDGLAQKASKAVRRAALRYEHLPEAAVADVVFSVQXREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEXASVIDGYAEKAYGRGTGEQRGRAAMTAAMIYADRRDYTKVRQWLKKVSAPEYLFDKGVLAAAAAVELDXGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKXDAESALPYLRYSFENDPEPEVAAHLGEVLWALGERDQAVDVWTQAAHLTGDKKIWRETLKRHGIALPQPSRKPRK

SEQ ID NO: 45 - DNA, 8 bp, Neisseria gonorrhoeae
  misc_feature (1)..(8): N= Unknown
nnnnnnnn

SEQ ID NO: 46 - protein, 300 aa, Neisseria gonorrhoeae
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNPHLDRLEEVPAQSDYVHQPMIFLLLVQAAVQHGGVAQKPSKAVRPAAYNYEVLPETAGADAVFCVQGPQYEKAIQSFPPCGRNPQTENIAPPFNELFRPTARPISPKLLQRFFRTEPNLAKPFRPPGPEMETYQTGFPRPLTRNNPT

SEQ ID NO: 47 - DNA, 1839 bp, Neisseria gonorrhoeae
atgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaaccggcggggtggctgcggaacgtattgaaggaagggggaaatcagcatctggacgggttgaaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgcccgaagcggcggttgccgatgcggtgttcggcgtacagggacgcgaaaaggaaaaggcaatcgaagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaataa

SEQ ID NO: 48 - protein, 612 aa, Neisseria gonorrhoeae
MLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKPAGWLRNVLKEGGNQHLDGLKEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 49 - DNA, 724 bp, Neisseria meningitidis
aacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgactgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctcsgwcrtgttcttcttcttccctgccggkstggtattgtactgggtagtcaacaacctcctgaccatcgcccagcaatggcacatcaaccgcagcatcgaaaaacaacgcgcccaaggcgaagtcgtttcctaa

SEQ ID NO: 50 - protein, 240 aa, Neisseria meningitidis
  misc_feature (198)..(199): Xaa= any amino acid
  misc_feature (207)..(207): Xaa= any amino acid
NLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSXXFFFFPAGXVLYWVVNNLLTIAQQWHINRSIEKQRAQGEVVS

SEQ ID NO: 51 - DNA, 1638 bp, Neisseria meningitidis
atggattttaaaagactcacggcgtttttcgccatcgcgctggtgattatgatcggctgggaaaagatgttccccactccgaagccagtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaa

SEQ ID NO: 52 - protein, 545 aa, Neisseria meningitidis
MDFKRLTAFFAIALVIMIGWEKMFPTPKPVPAPQQAAQQQAVTASAEAALAPATPITVTTDTVQAVIDEKSGDLRRLTLLKYKATGDENKPFILFGDGKEYTYVAQSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGRQSVCAAGECNIDIKRRNDKLYSTSVSVPLAAIQNGAKAEASINLYAGPQTTSVIANIADNLQLAKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 53 - DNA, 1638 bp, Neisseria meningitidis
  misc_feature (2)..(2): N= Unknown
  misc_feature (21)..(21): N= Unknown
  misc_feature (23)..(23): N= Unknown
  misc_feature (59)..(59): N= Unknown
  misc_feature (61)..(61): N= Unknown
  misc_feature (65)..(65): N= Unknown
  misc_feature (128)..(128): N= Unknown
  misc_feature (158)..(158): N= Unknown
  misc_feature (160)..(160): N= Unknown
  misc_feature (262)..(262): N= Unknown
  misc_feature (298)..(298): N= Unknown
  misc_feature (310)..(310): N= Unknown
  misc_feature (318)..(318): N= Unknown
  misc_feature (684)..(684): N= Unknown
  misc_feature (690)..(690): N= Unknown
  misc_feature (722)..(722): N= Unknown
  misc_feature (817)..(817): N= Unknown
  misc_feature (822)..(822): N= Unknown
  misc_feature (904)..(904): N= Unknown
  misc_feature (945)..(945): N= Unknown
  misc_feature (980)..(980): N= Unknown
  misc_feature (1389)..(1389): N= Unknown
  misc_feature (1501)..(1501): N= Unknown
  misc_feature (1503)..(1503): N= Unknown
  misc_feature (1506)..(1511): N= Unknown
  misc_feature (1519)..(1520): N= Unknown
anggattttaaaagactcacngngtttttcgccatcgcactggtgattatgatcggatngnaaangatgttccccactccgaagcccgtccccgcgccccaacagacggcacaacaacaggccgtaancgcttccgccgaagccgcgctcgcgcccgnancgccgattaccgtaacgaccgacacggttcaagccgtcattgatgaaaaaagcggcgacctgcgccggctgaccctgctcaaatacaaagcaaccggcgacnaaaataaaccgttcatcctgtttggcgacggcaaanaatacacctacntcgcccantccgaacttttggacgcgcagggcaacaacattctaaaaggcatcggctttagcgcaccgaaaaaacagtacagcttggaaggcgacaaagttgaagtccgcctgagcgcacctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggctactttacccactcttacgtcggccctgttgtttatacccctgaaggcaacttccaaaaagtcagcttctccgacttggacgacgatgccaantccggnaaatccgaggccgaatacatccgcaaaacccngaccggctggctcggcatgattgaacaccacttcatgtccacctggatcctccaacccaaaggcggacaaagcgtttgcgccgctggcgactgcngtatngacatcaaacgccgcaacgacaagctgtacagcaccagcgtcagcgtgcctttagccgctatccaaaacggtgcgaaatccnaagcctccatcaacctctacgccggcccacagaccacatcngttatcgcaaacatcgccgacaacctgcaactggncaaagactacggcaaagtacactggttcgcctcccccctcttttggcttttgaaccaactgcacaacatcatcggcaactggggctgggcgattatcgttttaaccatcatcgtcaaagccgtactgtatccattgaccaacgcctcttaccgttcgatggcgaaaatgcgtgccgccgcgcccaaactgcaagccatcaaagagaaatacggcgacgaccgtatggcgcagcaacaagccatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccntactacatcctgcccatcattatggcggcaacgatgttcgcccaaacctatctgaacccgccgccgaccgacccgatgcaggcgaaaatgatgaaaatcatgcctttggttntntcnnnnangttcttcnncttccctgccggtctggtattgtactgggtgatcaacaacctcctgaccatcgcccagcaatggcacatcaaccgcagcatcgaaaaacaacgcgcccaaggcgaagtcgtttcctaa

SEQ ID NO: 54 - protein, 545 aa, Neisseria meningitidis
  misc_feature (1)..(1): Xaa= any amino acid
  misc_feature (8)..(8): Xaa= any amino acid
  misc_feature (20)..(22): Xaa= any amino acid
  misc_feature (43)..(43): Xaa= any amino acid
  misc_feature (53)..(54): Xaa= any amino acid
  misc_feature (88)..(88): Xaa= any amino acid
  misc_feature (100)..(100): Xaa= any amino acid
  misc_feature (104)..(104): Xaa= any amino acid
  misc_feature (106)..(106): Xaa= any amino acid
  misc_feature (228)..(228): Xaa= any amino acid
  misc_feature (241)..(241): Xaa= any amino acid
  misc_feature (273)..(274): Xaa= any amino acid
  misc_feature (302)..(302): Xaa= any amino acid
  misc_feature (327)..(327): Xaa= any amino acid
  misc_feature (501)..(501): Xaa= any amino acid
  misc_feature (503)..(504): Xaa= any amino acid
  misc_feature (507)..(507): Xaa= any amino acid
XDFKRLTXFFAIALVIMIGXXXMFPTPKPVPAPQQTAQQQAVXASAEAALAPXXPITVTTDTVQAVIDEKSGDLRRLTLLKYKATGDXNKPFILFGDGKXYTYXAXSELLDAQGNNILKGIGFSAPKKQYSLEGDKVEVRLSAPETRGLKIDKVYTFTKGSYLVNVRFDIANGSGQTANLSADYRIVRDHSEPEGQGYFTHSYVGPVVYTPEGNFQKVSFSDLDDDAXSGKSEAEYIRKTXTGWLGMIEHHFMSTWILQPKGGQSVCAAGDCXXDIKRRNDKLYSTSVSVPLAAIQNGAKSXASINLYAGPQTTSVIANIADNLQLXKDYGKVHWFASPLFWLLNQLHNIIGNWGWAIIVLTIIVKAVLYPLTNASYRSMAKMRAAAPKLQAIKEKYGDDRMAQQQAMMQLYTDEKINPLGGCLPMLLQIPVFIGLYWALFASVELRQAPWLGWITDLSRADPYYILPIIMAATMFAQTYLNPPPTDPMQAKMMKIMPLVXSXXFFXFPAGLVLYWVINNLLTIAQQWHINRSIEKQRAQGEVVS

SEQ ID NO: 55 - DNA, 8 bp, Neisseria gonorrhoeae
  misc_feature (1)..(8): N= Unknown
nnnnnnnn

SEQ ID NO: 56 - protein, 243 aa, Neisseria gonorrhoeae
MAVNLYAGPQTTSVIANIADNLQLAKDYGKVHWFASPLFWLLNQLHNIIGNWGWAIVVLTIIVKAVLYPLTNASYRSMAKMRAAAPELQTIKEKYGDDRMAQQQAMMQLFEDEEINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 57 - DNA, 1641 bp, Neisseria gonorrhoeae
atggattttaaaagactcacggcgtttttcgccatcgcgctggtgattatgatcggctgggaaaaaatgttccccaccccgaaacccgtccccgcgccccaacaggcggcacaaaaacaggcagcaaccgcttccgccgaagccgcgctcgcgcccgcaacgccgattaccgtaacgaccgacacggttcaagccgttattgatgaaaaaagtggcgacctgcgccggctgaccctgctcaaatacaaagcaaccggcgacgaaaacaaaccgttcgtcctgtttggcgacggcaaagaatacacctacgtcgcccaatccgaacttttggacgcgcagggcaacaacattctgaaaggcatcggctttagcgcaccgaaaaaacagtacaccctcaacggcgacacagtcgaagtccgcctgagcgcgcccgaaaccaacggactgaaaatcgacaaagtctatacctttaccaaagacagctatctggtcaacgtccgcttcgacatcgccaacggcagcggtcaaaccgccaacctgagcgcggactaccgcatcgtccgcgaccacagcgaacccgagggtcaaggctactttacccactcttacgtcggccctgttgtttatacccctgaaggcaacttccaaaaagtcagcttctccgacttggacgacgatgcgaaatccggcaaatccgaggccgaatacatccgcaaaaccccgaccggttggctcggcatgattgaacaccacttcatgtccacctggatcctccaacctaaaggcggccaaaacgtttgcgcccagggagactgccgtatcgacattaaacgccgcaacgacaagctgtacagcgcaagcgtcagcgtgcctttaaccgctatcccaacccgggggccaaaaccgaaaatggcggtcaacctgtatgccggtccgcaaaccacatccgttatcgcaaacatcgccgacaacctgcaactggcaaaagactacggtaaagtacactggttcgcatcgccgctcttctggctcctgaaccaactgcacaacattatcggcaactggggctgggcaatcgtcgttttgaccatcatcgtcaaagccgtactgtatccattgaccaacgcctcctaccgttcgatggcgaaaatgcgtgccgccgcacccaaactgcagaccatcaaagaaaaatacggcgacgaccgtatggcgcaacagcaagcgatgatgcagctttacaaagacgagaaaatcaacccgctgggcggctgtctgcctatgctgttgcaaatccccgtcttcatcggcttgtactgggcattgttcgcctccgtagaattgcgccaggcaccttggctgggctggattaccgacctcagccgcgccgacccctactacatcctgcccatcattatggcggcaacgatgttcgcccaaacctatctgaacccgccgccgaccgacccgatgcaggcgaaaatgatgaaaatcatgccgttggttttctccgtcatgttcttcttcttccctgccggtttggttctctactgggtggtcaacaacctcctgaccatcgcccagcagtggcacatcaaccgcagcatcgaaaaacaacgcgcccaaggcgaagtcgtttcctaa

SEQ ID NO: 58 - protein, 546 aa, Neisseria gonorrhoeae
MDFKRLTAFFAIALVIMIGWEKMFPTPKPVPAPQQAAQKQAATASAEAALAPATPITVTTDTVQAVIDEKSGDLRRLTLLKYKATGDENKPFVLFGDGKEYTYVAQSELLDAQGNNILKGIGFSAPKKQYTLNGDTVEVRLSAPETNGLKIDKVYTFTKDSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGGQNVCAQGDCRIDIKRRNDKLYSASVSVPLTAIPTRGPKPKMAVNLYAGPQTTSVIANIADNLQLAKDYGKVHWFASPLFWLLNQLHNIIGNWGWAIVVLTIIVKAVLYPLTNASYRSMAKMRAAAPKLQTIKEKYGDDRMAQQQAMMQLYKDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 59 - DNA, 379 bp, Neisseria meningitidis
  misc_feature (51)..(51): N= Unknown
  misc_feature (122)..(122): N= Unknown
  misc_feature (149)..(149): N= Unknown
  misc_feature (237)..(237): N= Unknown
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgncacacaggcggcaaccgttacgaagtttttatcgcggtacgactggcaggctcaaaatacggggcaagaagagcttgaaccaggaactcgcgccctcattgtccgcaaggaaggcaaccttcttattatcacacacccttaa

SEQ ID NO: 60 - protein, 126 aa, Neisseria meningitidis
  misc_feature (41)..(41): Xaa= any amino acid
  misc_feature (50)..(50): Xaa= any amino acid
  misc_feature (89)..(89): Xaa= any amino acid
  misc_feature (94)..(94): Xaa= any amino acid
AVLIIELLTGTVYLLVVSAALAGSGIAYGLTGSTPAAVLTXALLSALGIXFVHAKTAVRKVETDSYQDLDAGQYVEILRHTGGNRYEVXYRGTXWQAQNTGQEELEPGTRALIVRKEGNLLIITHP

SEQ ID NO: 61 - DNA, 381 bp, Neisseria meningitidis
  misc_feature (51)..(51): N= Unknown
  misc_feature (122)..(122): N= Unknown
  misc_feature (149)..(149): N= Unknown
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaa

SEQ ID NO: 62 - protein, 126 aa, Neisseria meningitidis
  misc_feature (41)..(41): Xaa= any amino acid
  misc_feature (50)..(50): Xaa= any amino acid
AVLIIELLTGTVYLLVVSAALAGSGIAYGLTGSTPAAVLTXALLSALGIXFVHAKTAVRKVETDSYQDLDAGQYVEILRHTGGNRYEVFYRGTHWQAQNTGQEELEPGTRALIVRKEGNLLIITHP

SEQ ID NO: 63 - DNA, 408 bp, Neisseria meningitidis
atgactgtatggtttgttgccgctgttgccgtcttaatcatcgaattattgacgggaacggtttatcttttggttgtcagcgcggctttggcgggttcgggcattgcttacgggctgaccggcagcacgcctgccgccgtcttgaccgccgctctgctttccgcgctgggtatttggttcgtacacgccaaaaccgccgtgggaaaagttgaaacggattcatatcaggatttggatgccgggcaatatgccgaaatcctccggcacgcaggcggcaaccgttacgaagttttttatcgcggtacgcactggcaggctcaaaatacggggcaagaagagcttgaaccaggaacgcgcgccctaatcgtccgcaaggaaggcaaccttcttatcatcgcaaaaccttaa

SEQ ID NO: 64 - protein, 135 aa, Neisseria meningitidis
MTVWFVAAVAVLIIELLTGTVYLLVVSAALAGSGIAYGLTGSTPAAVLTAALLSALGIWFVHAKTAVGKVETDSYQDLDAGQYAEILRHAGGNRYEVFYRGTHWQAQNTGQEELEPGTRALIVRKEGNLLIIAKP

SEQ ID NO: 65 - DNA, 408 bp, Neisseria gonorrhoeae
atgactgtatggtttgttgccgctgttgccgtcttaatcatcgaattattgacgggaacggtttatcttttggttgtcagcgcggctttggcgggttcgggcattgcctacgggctgactggcagcacgcctgccgccgtcttgaccgccgcactgctttccgcgctgggcatttggttcgtacatgccaaaaccgccgtgggaaaagttgaaacggattcatatcaggatttggataccggaaaatatgccgaaatcctccgatacacaggcggcaaccgttacgaagttttttatcgcggtacgcactggcaggcgcaaaatacggggcaggaagtgtttgaaccgggaacgcgcgccctcatcgtccgcaaagaaggtaaccttcttatcatcgcaaacccttaa

SEQ ID NO: 66 - protein, 135 aa, Neisseria gonorrhoeae
MTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 67 - DNA, 407 bp, Neisseria meningitidis
atgtwtgatttcggtttrggcgarctggtttttgtcggcattatcgccctgatwgtcctcggccccgaacgcstgcccgaggccgcccgcaycgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtc

SEQ ID NO: 68 - protein, 136 aa, Neisseria meningitidis
  misc_feature (2)..(2): Xaa= any amino acid
  misc_feature (25)..(25): Xaa= any amino acid
  misc_feature (31)..(31): Xaa= any amino acid
  misc_feature (119)..(119): Xaa= any amino acid
MXDFGLGELVFVGIIALIVLGPERXPEAARXAGRLIGRLQRFVGSVKQEFDTQIELEELRKAKQEFEAAAAQVRDSLKETGTDMEGNLHDISDGLKPWEKLPEQRTPADFGVDENGNPXSRCGKHPIRRHFRRYAV

SEQ ID NO: 69 - DNA, 687 bp, Neisseria meningitidis
atgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacactcaaatcgaactggaagaactgaggaaggcaaagcaggaatttgaagctgccgccgctcaggttcgagacagcctcaaagaaaccggtacggatatggaaggcaatctgcacgacatttccgacggtctgaagccttgggaaaaactgcccgaacagcggacacctgccgatttcggtgtcgatgaaaacggcaatccgcttcccgatgcggcaaacaccctatcagacggcatttccgacgttatgccgtccgaacgttcctacgcttccgccgaaacccttggggacagcgggcaaaccggcagtacagccgaacccgcggaaaccgaccaagaccgcgcatggcgggaatacctgactgcttctgccgccgcacccgtcgtacagaccgtcgaagtcagctatatcgatactgctgttgaaacgcctgttccgcacaccacttccctgcgcaaacaggcaataagccgcaaacgcgattttcgtccgaaacaccgcgccaaacctaaattgcgcgtccgtaaatcataa

SEQ ID NO: 70 - protein, 228 aa, Neisseria meningitidis
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPLPDAANTLSDGISDVMPSERSYASAETLGDSGQTGSTAEPAETDQDRAWREYLTASAAAPVVQTVEVSYIDTAVETPVPHTTSLRKQAISRKRDFRPKHRAKPKLRVRKS

SEQ ID NO: 71 - DNA, 687 bp, Neisseria meningitidis
atgtttgatttcggtttgggcgagctggtttttgtcggcattatcgccctgattgtcctcggccccgaacgcctgcccgaggccgcccgcaccgccggacggctcatcggcaggctgcaacgctttgtcggcagcgtcaaacaggaatttgacacgcaaatcgaactggaagaactaaggaaggcaaagcaggaatttgaagctgccgctgctcaggttcgagacagcctcaaagaaaccggtacggatatggagggtaatctgcacgacatttccgacggtctgaagccttgggaaaaactgcccgaacagcgcacgcctgctgatttcggtgtcgatgaaaacggcaatccctttcccgatgcggcaaacaccctattagacggcatttccgacgttatgccgtccgaacgttcctacgcttccgccgaaacccttggggacagcgggcaaaccggcagtacagccgaacccgcggaaaccgaccaagaccgtgcatggcgggaatacctgactgcttctgccgccgcacccgtcgtacagaccgtcgaagtcagctatatcgataccgctgttgaaacccctgttccgcataccacttcgctgcgtaaacaggcaataagccgcaaacgcgatttgcgtcctaaatcccgcgccaaacctaaattgcgcgtccgtaaatcataa

SEQ ID NO: 72 - protein, 228 aa, Neisseria meningitidis
MFDFGLGELVFVGIIALIVLGPERLPEAARTAGRLIGRLQRFVGSVKQEFDTQIELEELRKAKQEFEAAAAQVRDSLKETGTDMEGNLHDISDGLKPWEKLPEQRTPADFGVDENGNPFPDAANTLLDGISDVMPSERSYASAETLGDSGQTGSTAEPAETDQDRAWREYLTASAAAPVVQTVEVSYIDTAVETPVPHTTSLRKQAISRKRDLRPKSRAKPKLRVRKS

SEQ ID NO: 73 - DNA, 8 bp, Neisseria gonorrhoeae
  misc_feature (1)..(8): N= Unknown
nnnnnnnn

SEQ ID NO: 74 - protein, 136 aa, Neisseria gonorrhoeae
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDEKGNSLSRYGKHRIRRHFRRYAV

SEQ ID NO: 75 - DNA, 690 bp, Neisseria gonorrhoeae
atgtttgatttcggtttgggcgagctgatttttgtcggcattatcgccctgattgtccttggtccagaacgcctgcccgaagccgcccgcactgccggacggcttatcggcaggctgcaacgctttgtaggaagcgtcaaacaagaacttgacactcaaatcgaactggaagagctgaggaaggtcaagcaggcattcgaagctgccgccgctcaggttcgagacagcctcaaagaaaccgatacggatatgcagaacagtctgcacgacatttccgacggtctgaagccttgggaaaaactgcccgaacagcgcacgcctgccgatttcggtgtcgatgaaaacggcaatccccttcccgatacggcaaacaccgtatcagacggcatttccgacgttatgccgtctgaacgttccgatacttccgccgaaacccttggggacgacaggcaaaccggcagtacagccgaacctgcggaaaccgacaaagaccgcgcatggcgggaatacctgactgcttctgccgccgcacctgtcgtacagagggccgtcgaagtcagctatatcgatactgctgttgaaacgcctgttccgcacaccacttccctgcgcaaacaggcaataaaccgcaaacgcgatttttgtccgaaacaccgcgccaaaccgaaattgcgcgtccgtaaatcataa

SEQ ID NO: 76 - protein, 229 aa, Neisseria gonorrhoeae
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDENGNPLPDTANTVSDGISDVMPSERSDTSAETLGDDRQTGSTAEPAETDKDRAWREYLTASAAAPVVQRAVEVSYIDTAVETPVPHTTSLRKQAINRKRDFCPKHRAKPKLRVRKS

SEQ ID NO: 77 - DNA, 639 bp, Neisseria meningitidis
atgcaagcacggctgctgatacctattcttttttcagtttttattttatccgctgcgggacactgacaggtattccatcgcatggcggagktaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcackgrtwcstggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatg

SEQ ID NO: 78 - protein, 213 aa, Neisseria meningitidis
  misc_feature (31)..(31): Xaa= any amino acid
  misc_feature (87)..(89): Xaa= any amino acid
MQARLLIPILFSVFILSACGTLTGIPSHGGXKRFAVEQELVAASARAAVKDMDLQALHGRKVALYIATMGDQGSGSLTGGRYSIDAXXXGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEM

SEQ ID NO: 79 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 80 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 81 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 82 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 83 - DNA, 963 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaaccttga

SEQ ID NO: 84 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 85 - DNA, 590 bp, Neisseria meningitidis
ggcagcacaaaaaacaggcggttgaacggaaaaaccgtatttacgatgatgccgggtatgatattcggcgtattcacgggcgcattctccgcaaaatatatccccgcgttcgggcttcaaattttcttcatcctgtttttaaccgccgtcgcattcaaaacactgcataccgaccctcagacggcatcccgcccgctgcccggactgcccrgactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaa

SEQ ID NO: 86 - protein, 196 aa, Neisseria meningitidis
  misc_feature (71)..(71): Xaa= any amino acid
GQHKKQAVNGKTVFTMMPGMIFGVFTGAFSAKYIPAFGLQIFFILFLTAVAFKTLHTDPQTASRPLPGLPXLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 87 - DNA, 806 bp, Neisseria meningitidis
atgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaa

SEQ ID NO: 88 - protein, 268 aa, Neisseria meningitidis
  misc_feature (251)..(251): Xaa= any amino acid
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMIFGVFTGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKXFGIMLLLIAGKMLYNLL

SEQ ID NO: 89 - DNA, 807 bp, Neisseria meningitidis
atgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatggtattcggcgtattcgctggcgcactctccgcaaaatatatcccagcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatccttcggcattatgttgcttttgattgccggaaaaatgctgtacaacctgctttaa

SEQ ID NO: 90 - protein, 268 aa, Neisseria meningitidis
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMVFGVFAGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSFGIMLLLIAGKMLYNLL

SEQ ID NO: 91 - DNA, 8 bp, Neisseria gonorrhoeae
  misc_feature (1)..(8): N= Unknown
nnnnnnnn

SEQ ID NO: 92 - protein, 268 aa, Neisseria gonorrhoeae
MWHWDIILILLAVGSAAGFIAGLFGVGGGTLIVPVVLWVLDLQGLAQHPYAQHLAVGTSFAVMVFTAFSSMLGQHKKQAVDWKTIFAMMPGMIFGVFAGALSAKYIPAFGLQIFFILFLTAVAFKTLHTGRQTASRPLPGLPGLTAVSTLFGAMSSWVGIGGGSLSVPFLIHCGFPAHKAIGTSSGLAWPIALSGAISYLVNGLNIAGLPEGSLGFLYLPAVAVLSAATIAFAPLGVKTAHKLSSAKLKESFGIMLLLIAGKMLYNLL

SEQ ID NO: 93 - DNA, 807 bp, Neisseria gonorrhoeae
atgtggcattgggacattatcttaatcctgcttgccgtaggcagtgcggcaggttttattgccggcctgttcggtgtaggcggcggtacgctgattgtccctgtcgttttatgggtgcttgatttgcagggtttggcacaacatccttacgcgcaacacctcgccgtcggcacatccttcgccgtcatggtcttcaccgccttttccagtatgttggggcagcacaaaaaacaggcggtcgactggaaaaccatatttgcgatgatgccgggtatgatattcggcgtattcgctggcgcactctccgcaaaatatatccccgcgttcgggcttcaaattttcttcatcctgtttttaaccgccgtcgcattcaaaacactgcataccggtcgtcagacggcatcccgcccgctgcccgggctgcccggactgactgcggtttccacactgttcggcgcaatgtcgagctgggtcggcataggcggcggttcactttccgtccccttcttaatccactgcggcttccccgcccataaagccatcggcacatcatccggccttgcctggccgattgcactctccggcgcaatatcgtatctggtcaacggtctgaatattgcaggattgcccgaagggtcgctgggcttcctttacctgcccgccgtcgccgtcctcagcgcggcaaccattgcctttgccccgctcggtgtcaaaaccgcccacaaactttcttctgccaaactcaaagaatccttcggcattatgttgcttttgattgccggaaaaatgctgtacaacctgctttaa

SEQ ID NO: 94 - protein, 268 aa, Neisseria gonorrhoeae; identical to SEQ ID NO: 92

SEQ ID NO: 95 - DNA, 351 bp, Neisseria meningitidis
ggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataa

SEQ ID NO: 96 - protein, 116 aa, Neisseria meningitidis
GNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 97 - DNA, 606 bp, Neisseria meningitidis
atgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataa

SEQ ID NO: 98 - protein, 201 aa, Neisseria meningitidis
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGGLTAALMQVSVLVLLLSEIGR

SEQ ID NO: 99 - DNA, 606 bp, Neisseria meningitidis
  misc_feature (373)..(373): N= Unknown
  misc_feature (522)..(522): N= Unknown
  misc_feature (565)..(565): N= Unknown
atgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacggatggaaacggatggcaggcagaccccgaacatcctctgctcgggctgtttgccgtcagtaatgtatcgatgacgcttgcttttgtcggaatatgtgcgttggtgcattattgcttttcgngaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggntcgcagctgcgactcggcgggttgacggcagcgttgatgcagntctcggtactggtgctgctgctttcagaaattggaagataa

SEQ ID NO: 100 - protein, 201 aa, Neisseria meningitidis
  misc_feature (125)..(125): N= Unknown
  misc_feature (189)..(189): N= Unknown
MILLHLDFLSALLYAAVFLFLIFRAGMLQWFWASIMLWLGISVLGAKLMPGIWGMTRAAPLFIPHFYLTLGSIFFFIGHWNRKTDGNGWQADPEHPLLGLFAVSNVSMTLAFVGICALVHYCFSXTVQVFVFAALLKLYALKPVYWFVLQFVLMAVAYVHRCGIDRQPPSTFGGSQLRLGGLTAALMQXSVLVLLLSEIGR

SEQ ID NO: 101 - DNA, 606 bp, Neisseria gonorrhoeae
  misc_feature (125)..(125): N= Unknown
  misc_feature (189)..(189): N= Unknown
atgattttgctgcatttggattttttgtctgccttactgtatgcggcggtttttctgtttctgatattccgcgcaggaatgttgcaatggttttgggcgagtattgcgttgtggctcggcatctcggttttaggggtaaagctgatgccggggatgtggggaatgacccgcgccgcgcctttgttcatcccccatttttacctgactttgggcagcatattttttttcatcgggtattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcattgctcaaactttatgcgctgaagccggtttattggttcgtgttgcagtttgtattgatggcggttgcctatgtccaccgctgcggtatagaccggcagccgccgtcaacgttcggcggttcgcagctgcgactcggcgtgttggcggcgatgttgatgcaggttgcggtaacggcgatgctgcttgccgaaatcggcagatga

SEQ ID NO: 102 - protein, 201 aa, Neisseria meningitidis
MILLHLDFLSALLYAAVFLFLIFRAGMLQWFWASIALWLGISVLGVKLMPGMWGMTRAAPLFIPHFYLTLGSIFFFIGYWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGVLAAMLMQVAVTAMLLAEIGR

SEQ ID NO: 103 - DNA, 308 bp, Neisseria gonorrhoeae
  misc_feature (30)..(30): N= Unknown
  misc_feature (161)..(161): N= Unknown
  misc_feature (163)..(163): N= Unknown
  misc_feature (177)..(177): N= Unknown
  misc_feature (306)..(306): N= Unknown
atgaaaaccccactcctcaagcctctgctnattacctcgcttcccgttttcgccagtgtttttaccgccgcctccatcgtctggcagctaggcgaacccaagctcgccatgcccttcgtactcggcatcatcgccggcggccttgtcgatttggacaaccncntgaccggacggctnaaaaacatcatcaccaccgtcgccctgttcaccctctcctcgctcacggcacaaagcaccctcggcacagggctgcccttcatcctcgccatgaccctgatgacttcgcttcaccattttaggcgcggncg

SEQ ID NO: 104 - protein, 103 aa, Neisseria meningitidis
  misc_feature (54)..(55): Xaa= any amino acid
  misc_feature (95)..(96): Xaa= any amino acid
  misc_feature (103)..(103): Xaa= any amino acid
MKTPLLKPLLITSLPVFASVFTAASIVWQLGEPKLAMPFVLGIIAGGLVDLDNXXTGRLKNIITTVALFTLSSLTAQSTLGTGLPFILAMTLMTXXFTILGAX

SEQ ID NO: 105 - DNA, 2151 bp, Neisseria meningitidis
atgaaaaccccactcctcaagcctctgctcattacctcgcttcccgttttcgccagtgtttttaccgccgcctccatcgtctggcagctaggcgaacccaagctcgccatgcccttcgtactcggcatcatcgccggcggccttgtcgatttggacaaccgcctgaccggacggctgaaaaacatcatcaccaccgtcgccctgttcaccctctcctcgctcacggcacaaagcaccctcggcacagggctgcccttcatcctcgccatgaccctgatgaccttcggcttcaccattttaggcgcggtcgggctcaaataccgcaccttcgccttcggtgcactcgccgtcgccacctacaccacacttacctacacccccgaaacctactggctgaccaaccccttcatgattttatgcggcaccgtactgtacagcaccgccatcctcctgttccaaatcgtcctgccccaccgccccgtccaagaaagcgtcgccaacgcctacgacgcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgttactactttgccgcccaagacatacacgaacgcatcagctccgcccacgtcgattatcaggaaatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacagtcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccagcagcctcaaaaacacctggcaggcaatccgtccgcagctaaacctcgaatcaggcgtattccgccatgccgtccgcctgtccctcgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctacttcaccccgtctgtcgaaaccaaactctggattgtcatcgccagtaccaccctctttttcatgacccgcacctacaaatacagtttctccaccttcttcattaccattcaagccctgaccagcctctccctcgcaggtttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggtgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccgacagctcgaaccctactaccgcgcctaccgccaaattccgcacaggcagccccaaaatgcagcctga

SEQ ID NO: 106 - protein, 716 aa, Neisseria meningitidis
MKTPLLKPLLITSLPVFASVFTAASIVWQLGEPKLAMPFVLGIIAGGLVDLDNRLTGRLKNIITTVALFTLSSLTAQSTLGTGLPFILAMTLMTFGFTILGAVGLKYRTFAFGALAVATYTTLTYTPETYWLTNPFMILCGTVLYSTAILLFQIVLPHRPVQESVANAYDALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDSPDIRHLRRLLDNLGSVDQQFRQLQHNGLQAENDRMGDTRIAALETSSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 107 - DNA, 2151 bp, Neisseria meningitidis
atgaaaaccccacccctcaagcctctgctcattacctcgcttcccgttttcgccagtgtctttaccgccgcctccatcgtctggcagctgggcgaacccaagctcgccatgcccttcgtactcggcatcatcgctggcggcctggtcgatttggacaaccgcctgaccggacggctgaaaaacatcatcgccaccgtcgccctgttcaccctctcctcacttgtcgcgcaaagcaccctcggcacaggtttgccattcatcctcgccatgaccctgatgactttcggctttaccatcatgggcgcggtcgggctgaaataccgcaccttcgccttcggcgcactcgccgtcgccacctacaccacacttacctacacccccgaaacctactggctgaccaacccctttatgattctgtgcggaaccgtactgtacagcaccgccatcatcctgttccaaatcatcctgccccaccgccccgttcaagaaaacgtcgccaacgcctacgaagcactcggcagctacctcgaagccaaagccgactttttcgatcccgacgaagccgaatggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgctactacttcgccgcccaagacatacacgaacgcatcagctccgcccacgtcgactaccaagagatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacaatcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccggcagcctcaaaaacacctggcaggcaatccgtccgcagctaaacctcgaatcaggcgtattccgccatgccgtccgcctgtcccttgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctactttaccccctccgtcgaaaccaaactctggatcgtcatcgccagtaccaccctctttttcatgacccgcacctacaaatacagcttctcgacatttttcatcaccattcaagccctgaccagcctctccctcgcagggttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggcgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccggcagctcgaaccctactaccgcgcctaccgacaaattccgcacaggcagccccaaaacgcagcctga

SEQ ID NO: 108 - protein, 716 aa, Neisseria meningitidis
MKTPPLKPLLITSLPVFASVFTAASIVWQLGEPKLAMPFVLGIIAGGLVDLDNRLTGRLKNIIATVALFTLSSLVAQSTLGTGLPFILAMTLMTFGFTIMGAVGLKYRTFAFGALAVATYTTLTYTPETYWLTNPFMILCGTVLYSTAIILFQIILPHRPVQENVANAYEALGSYLEAKADFFDPDEAEWIGNRHIDLAMSNTGVITAFNQCRSALFYRLRGKHRHPRTAKMLRYYFAAQDIHERISSAHVDYQEMSEKFKNTDIIFRIHRLLEMQGQACRNTAQALRASKDYVYSKRLGRAIEGCRQSLRLLSDSNDNPDIRHLRRLLDNLGSVDQQFRQLQHNGLQAENDRMGDTRIAALETGSLKNTWQAIRPQLNLESGVFRHAVRLSLVVAAACTIVEALNLNLGYWILLTALFVCQPNYTATKSRVRQRIAGTVLGVIVGSLVPYFTPSVETKLWIVIASTTLFFMTRTYKYSFSTFFITIQALTSLSLAGLDVYAAMPVRIIDTIIGASLAWAAVSYLWPDWKYLTLERTAALAVCSNGAYLEKITERLKSGETGDDVEYRATRRRAHEHTAALSSTLSDMSSEPAKFADSLQPGFTLLKTGYALTGYISALGAYRSEMHEECSPDFTAQFHLAAEHTAHIFQHLPETEPDDFQTALDTLRGELDTLRTHSSGTQSHILLQQLQLIARQLEPYYRAYRQIPHRQPQNAA

SEQ ID NO: 109 - DNA, 8 bp, Neisseria gonorrhoeae
  misc_feature (1)..(8): N= Unknown
nnnnnnnn

SEQ ID NO: 110 - protein, 370 aa, Neisseria meningitidis
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNT

SEQ ID NO: 111 - DNA, 2151 bp, Neisseria gonorrhoeae
atgaaaaccccactcctcaagcctctgctcattacctcgcttcccgttttcgccagtgtctttaccgccgcctccatcgtctggcagctaggcgaacccaagctcgccatgcccttcgtactcggcatcatcgccggcggcctggtcgatttggacaaccgcctgaccggacggctgaaaaacatcatcgccaccgtcgccctgtttaccctctcctcgctcacggcgcaaagcaccctcggcacagggctgcccttcatcctcgccatgaccctgatgaccttcggctttaccattttaggcgcggtcgggctgaaataccgcaccttcgccttcggcgcactcgccgtcgccacctacaccacgcttacctacacccccgaaacctactggctgaccaaccccttcatgattttatgcggcaccgtactgtacagcaccgccatcatcctgttccaaatcatcctgccccaccgccccgtccaagaaagcgtcgccaatgcctacgaagcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgtttgcgcggcaaacaccgccacccgcgcaccgccaaaatgctgcgctactacttcgccgcccaagacatccacgaacgcatcagctccgcccacgtcgactaccaagagatgtccgaaaaattcaaaaacaccgacatcatcttccgcatccgccgcctgctcgaaatgcaggggcaggcgtgccgcaacaccgcccaagccatccggtcgggcaaagactacgtttacagcaaacgcctcggacgcgccatcgaaggctgccgccagtcgctgcgcctcctttcagacggcaacgacagtcccgacatccgccacctgagccgccttctcgacaacctcggcagcgtcgaccagcagttccgccaactccgacacagcgactcccccgccgaaaacgaccgcatgggcgacacccgcatcgccgccctcgaaaccggcagcttcaaaaacacctggcaggcaatccgtccgcagctgaacctcgaatcatgcgtattccgccatgccgtccgcctgtccctcgtcgttgccgccgcctgcaccatcgtcgaagccctcaacctcaacctcggctactggatactgctgaccgcccttttcgtctgccaacccaactacaccgccaccaaaagccgcgtgtaccaacgcatcgccggcaccgtactcggcgtaatcgtcggctcgctcgtcccctacttcaccccctccgtcgaaaccaaactctggattgtcatcgccggtaccaccctgttcttcatgacccgcacctacaaatacagtttctccaccttcttcatcaccattcaggcactgaccagcctctccctcgcaggtttggacgtatacgccgccatgcccgtgcgcatcatcgacaccattatcggcgcatcccttgcctgggcggcggtcagctacctgtggccagactggaaatacctcacgctcgaacgcaccgccgcccttgccgtatgcagcagcggcacatacctccaaaaaattgccgaacgcctcaaaaccggcgaaaccggcgacgacatagaataccgcatcacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccaccttgccgccgaacacaccgcccacatcttccaacacctgcccgacatgggacccgacgactttcagacggcattggatacactgcgcggcgaactcggcaccctccgcacccgcagcagcggaacacaaagccacatcctcctccaacagctccaactcatcgcccggcaactcgaaccctactaccgcgcctaccgacaaattccgcacaggcagccccaaaacgcagcctga

SEQ ID NO: 112 - protein, 716 aa, Neisseria gonorrhoeae
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNTWQAIRPQLNLESCVFRHAVRLSLVVAAACTIVEALNLNLGYWILLTALFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADSLQPGFTLLKTGYALTGYISALGAYRSEMHEECSPDFTAQFHLAAEHTAHIFQHLPDMGPDDFQTALDTLRGELGTLRTRSSGTQSHILLQQLQLIARQLEPYYRAYRQIPHRQPQNAA

SEQ ID NO: 113 - DNA, 1363 bp, Neisseria meningitidis
atgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcgaagcctttatccgccatgtggcggggatgctgtcgtttgtactggttatcgttaccgcgctgggcatacttgccgcgccttgggtgatttatgtttccgcacccgagttttgcccaagatgccgacaaatttcagctctccatcgatttgctgcggattacgtttccttatatattattgatttccctgtcttcatttgtcggctcggtactcaattcttatcataagttcggcattccggcgtttacgccacgtttctgaacgtgtcgtttatcgtattcgcgctgtttttcgtgccgtatttcgatccgcccgttaccgcgcyggcgtgggcggtctttgtcggcggcattttgcaactcgrmttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgwatttacgctgtttgacgcgcagatgacgcaacacgcgctgattgcctattctttcggtttaatcggcttaatcatgattaaagtgttggcacccggcttctatgcgcggcaaaacatcaawamgcccgtcaaaatcgccatcttcacgctcatctgcmcgcagttgatgaaccttgsctttaycggcccactrraacrcastcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtga

SEQ ID NO: 114 - protein, 454 aa, Neisseria meningitidis
  misc_feature (80)..(80): Xaa= any amino acid
  misc_feature (165)..(165): Xaa= any amino acid
  misc_feature (189)..(189): Xaa= any amino acid
  misc_feature (202)..(202): Xaa= any amino acid
  misc_feature (341)..(341): Xaa= any amino acid
  misc_feature (381)..(382): Xaa= any amino acid
  misc_feature (394)..(394): Xaa= any amino acid
  misc_feature (400)..(400): Xaa= any amino acid
  misc_feature (402)..(402): Xaa= any amino acid
  misc_feature (406)..(407): Xaa= any amino acid
  misc_feature (438)..(438): Xaa= any amino acid
  misc_feature (446)..(446): Xaa= any amino acid
MNMLGALAKVGSLTMVSRVLGFVRDTVIARAFGAGMATDAFFVAFKLPNLLRRVFAEGAFAQAFVPILAEYKETRSKEAXEAFIRHVAGMLSFVLVIVTALGILAAPWVIYVSAPSFAQDADKFQLSIDLLRITFPYILLISLSSFVGSVLNSYHKFGIPAFTPXFLNVSFIVFALFFVPYFDPPVTAXAWAVFVGGILQLXFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYRXFTLFDAQMTQHALIAYSFGLIGLIMIKVLAPGFYARQNIXXPVKIAIFTLICXQLMNLXFXGPLXXIGLSLAIGLGACINAGLLFYLLRRHGIYQPXQGLGSVLXQKCCSRSP

SEQ ID NO: 115 - DNA, 1539 bp, Neisseria meningitidis
atgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgaatttacgctgtttgacgcgcagatgacgcaacacgcgctgattgcctattctttcggtttaatcggcttaatcatgattaaagtgttggcacccggcttctatgcgcggcaaaacatcaaaacgcccgtcaaaatcgccatcttcacgctcatctgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtgatgtgcggcggactgtgggcagcgcaggcttacctgccgtttgaatgggcgcacgccggcggaatgcggaaagcggggcagctctgcatcctgattgccgtcggcggcggactgtatttcgcatcactggcggctttgggcttccgtccgcgccatttcaaacgcgtggaaaactga

SEQ ID NO: 116 - protein, 512 aa, Neisseria meningitidis
MNMLGALAKVGSLTMVSRVLGFVRDTVIARAFGAGMATDAFFVAFKLPNLLRRVFAEGAFAQAFVPILAEYKETRSKEAAEAFIRHVAGMLSFVLVIVTALGILAAPWVIYVSAPGFAQDADKFQLSIDLLRITFPYILLISLSSFVGSVLNSYHKFGIPAFTPTFLNVSFIVFALFFVPYFDPPVTALAWAVFVGGILQLGFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMCGGLWAAQAYLPFEWAHAGGMRKAGQLCILIAVGGGLYFASLAALGFRPRHFKRVEN

SEQ ID NO: 117 - DNA, 1539 bp, Neisseria meningitidis
  misc_feature (937)..(937): N= Unknown
atgaatatgctgggagctttggtaaaagtcggcagcctgacgatggtgtcgcgcgttttgggatttgtgcgcgatacggtcattgcgcgcgcattcggcgcaggcatggcgacggatgcgttctttgtcgcgttcaaactgcccaacctgcttcgccgcgtgtttgcggagggggcgtttgcccaagcgtttgtgccgattttggcggaatataaggaaacgcgttctaaagaggcgacggaggcttttatccgccatgtggcggggatgctgtcgtttgtactggtcatcgttaccgcgctgggcatacttgccgcgccttgggtgatttatgtttccgcacccggttttgccaaagatgccgacaaatttcagctctctatcgatttgctgcggattacgtttccttatatcttattgatttcactttcctcttttgtcggctcggtactcaattcctatcataaattcagcattcctgcgtttacgcccacgttcctgaacgtgtcgtttatcgtattcgcgctgtttttcgtgccgtatttcgatcctcccgttaccgcgctggcttgggcggtttttgtcggcggcattttgcaactcggcttccaactgccctggctggcgaaactgggttttttgaaactgcccaaactgagtttcaaagatgcggcggtcaaccgcgtgatgaaacagatggcgcctgcgattttgggcgtgagcgtggcgcagatttctttggtgatcaacacgattttcgcgtcttatctgcaatcgggcagcgtttcatggatgtattacgccgaccgcatgatggaactgcccggcggcgtgctgggggcggcactcggtacgattttgctgccgactttgtccaaacactcggcaaaccaagatacggaacagttttccgccctgctcgactggggtttgcgcntgtgcatgctgctgacgctgccggcggcggtcggaatggcggtgttgtcgttcccgctggtggcaaccttgtttatgtaccgagaattcacgctgtttgacgcgcagatgacgcaacacgcgctgattgcctattctttcggtttaatcggtttaatcatgattaaagtgttggcgcccggcttttatgcgcggcaaaacatcaaaacgcccgtcaaaatcgccatcttcacgctcatttgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttggcaaaaatgctgctctcgctcgccgtgatgggaggcggcctgtatgccgcccaaatctggctgccgttcgactgggcacacgccggcggaatgcaaaaggccgcccggctcttcatcctgattgccgtcggcggcggactgtatttcgcatcactggcggctttgggcttccgtccgcgccatttcaaacgcgtggaaagctga

SEQ ID NO: 118 - protein, 512 aa, Neisseria meningitidis
  misc_feature (313)..(313): Xaa= any amino acid
MNMLGALVKVGSLTMVSRVLGFVRDTVIARAFGAGMATDAFFVAFKLPNLLRRVFAEGAFAQAFVPILAEYKETRSKEATEAFIRHVAGMLSFVLVIVTALGILAAPWVIYVSAPGFAKDADKFQLSIDLLRITFPYILLISLSSFVGSVLNSYHKFSIPAFTPTFLNVSFIVFALFFVPYFDPPVTALAWAVFVGGILQLGFQLPWLAKLGFLKLPKLSFKDAAVNRVMKQMAPAILGVSVAQISLVINTIFASYLQSGSVSWMYYADRMMELPGGVLGAALGTILLPTLSKHSANQDTEQFSALLDWGLRXCMLLTLPAAVGMAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMGGGLYAAQIWLPFDWAHAGGMQKAARLFILIAVGGGLYFASLAALGFRPRHFKRVES

SEQ ID NO: 119 - DNA, 8 bp, Neisseria gonorrhoeae
  misc_feature (1)..(8): N= Unknown
nnnnnnnn

SEQ ID NO: 120 - protein, 454 aa, Neisseria gonorrhoeae
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELPGGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLFRKHGIYRPGQGLGQPSWRKCCSRSP

SEQ ID NO: 121 - DNA, 1539 bp, Neisseria gonorrhoeae
atgaatatgcttggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatataaggaaacgcgttctaaagaggcgacggaggcttttatccgccacgttgcgggaatgctgtcgtttgtgctgatcgtcgttaccgcgctgggcatacttgccgcgccttgggtgatttatgtttccgcgcccggctttaccaaagacgcggacaagttccaactttccatcagcctgctgcggattacgtttccttatatattattgatttctttgtcttcttttgtcggctcgatactcaattcctaccataagttcggcattcccgcgtttacgcccacgtttttaaacatctcttttatcgtattcgcactgtttttcgtgccgtatttcgatccgcccgttaccgcgctggcgtgggcggtttttgtcggcggtattttgcagctcggtttccaactgccgtggctggcgaaactgggctttttgaaactgcccaaactgaatttcaaagatgcggcggtcaaccgcgtcatgaaacagatggcgcctgcgattttgggcgtgagcgtggcgcaaatttctttggttatcaacacgattttcgcgtcttatctgcaatcgggcagcgtttcatggatgtattacgccgaccgcatgatggagctgcgccggggcgtgctgggggctgcactcggtacaattttgctgccgactttgtccaaacactcggcaaaccaagatacggaacagttttccgccctgctcgactggggtttgcgcctgtgcatgctgctgacgctgccggcggcggccggactggcggtattgtcgttcccgctggtggcgacgctgtttatgtaccgagaattcacgctgtttgacgcacaaatgacgcaacacgcgctgattgcctattctttcggtttaatcggtttaattatgattaaagtgttggcatccggcttttatgcgcggcaaaacatcaaaacgcccgtcaaaatcgccatcttcacgctcatctgcacgcagttgatgaacctcgcctttatcggtccgttgaaacacgccgggctttcgctcgccatcggcctgggcgcgtgcatcaacgccggattgttgttcttcctgttgcgcaaacacggtatttaccggcccggcaggggttgggcggcgttcttggcgaaaatgctgctcgcgctcgccgtgatgtgcggcggactgtgggcggcgcaggcttgcctgccgttcgaatgggcgcacgccggcggaatgcggaaagcggggcagctctgcatcctgattgccgtcggcggcggactgtatttcgcatctctggcggctttgggcttccgtccgcgccatttcaaacgcgtggaaagctga

SEQ ID NO: 122 - protein, 512 aa, Neisseria gonorrhoeae
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELRRGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLLRKHGIYRPGRGWAAFLAKMLLALAVMCGGLWAAQACLPFEWAHAGGMRKAGQLCILIAVGGGLYFASLAALGFRPRHFKRVES

SEQ ID NO: 123 - DNA, 474 bp, Neisseria meningitidis
atgattaaaatcaaaaaaggtctaaacctgcccatcgcgggcagaccggagcaagccgtttacgacggcccggccattaccgaagtcgcgttgcttggcgaagaatatgccggtatgcgcccctcgatgaaagtcaaggaaggcgatgccgtcaaaaaaggccaagtgctgtttgaagacaaaaagaatccgggcgtggtgtttactgcgccggcttcaggcaaaatcgccgcgattcaccgtggcgaaaagcgcgtacttcagtcagtcgtgattgccgttgaargcaacgacgaaatcgagtttgaacgctacgcacctgaagcgctggcaaacttaagcggcgaagaagtgcgccgcaacctgatccaatccggtttgtggactgcgctgcgcacccgtccgttcagcaaaattcctgccgtcgatgccgagccgttcgccatcttcgtcaatgcgatggacaccaatccg

SEQ ID NO: 124 - protein, 158 aa, Neisseria meningitidis
  misc_feature (96)..(96): Xaa= any amino acid
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEXNDEIEFERYAPEALANLSGEEVRRNLIQSGLWTALRTRPFSKIPAVDAEPFAIFVNAMDTNP

SEQ ID NO: 125 - DNA, 1344 bp, Neisseria meningitidis
atgattaaaatcaaaaaaggtctaaacctgcccatcgcgggcagaccggagcaagccgtttacgacggcccggccattaccgaagtcgcgttgcttggcgaagaatatgccggtatgcgcccctcgatgaaagtcaaggaaggcgatgccgtcaaaaaaggccaagtgctgtttgaagacaaaaagaatccgggcgtggtgtttactgcgccggcttcaggcaaaatcgccgcgattcaccgtggcgaaaagcgcgtacttcagtcagtcgtgattgccgttgaaggcaacgacgaaatcgagtttgaacgctacgcacctgaagcgctggcaaacttaagcggcgaagaagtgcgccgcaacctgatccaatccggtttgtggactgcgctgcgcacccgtccgttcagcaaaattcctgccgtcgatgccgagccgttcgccatcttcgtcaatgcgatggacaccaatccgctggctgccgaccctacggtcattatcaaagaagccgccgaggatttcaaacgcggcctgttggtattgagccgtttgaccgaacgcaaaatccatgtttgtaaggcagctggcgcagacgtgccgtctgaaaatgctgccaacatcgaaacacatgaattcggcggcccgcatcctgccggtttgagtggcacgcacattcatttcatcgagccggtcggcgcgaataaaaccgtgtggaccatcaattatcaagatgtaattaccattggccgtttgtttgcaacaggccgtctgaacaccgagcgcgtgattgccctaggtggttctcaagtcaacaaaccgcgcctcttgcgtaccgttttgggtgcgaaagtatcgcaaattactgcgggcgaattggttgacacagacaaccgcgtgatttccggttcggtattgaacggcgcgattacacaaggcgcgcacgattatttgggacgctaccacaatcagatttccgttatcgaagaaggccgcagcaaagagctgttcggctgggttgcgccgcagccggacaaatactccatcacgcgtacaaccctcggccatttcctgaaaaacaaactcttcaagttcaacacagccgtcaacggcggcgaccgcgccatggtgccgattggtacttacgagcgcgtgatgcccttggatatcctgcccaccctgcttttgcgcgatttaatcgtcggcgataccgacagcgcgcaggcattgggttgcttggaattggacgaagaagacctcgctttgtgcagcttcgtctgcccgggcaaatacgaatacggcccgctgttgcgcaaagtgctggaaaccattgagaaggaaggctga

SEQ ID NO: 126 - protein, 447 aa, Neisseria meningitidis
MIKIKKGLNLPIAGRPEQAVYDGPAITEVALLGEEYAGMRPSMKVKEGDAVKKGQVLFEDKKNPGVVFTAPASGKIAAIHRGEKRVLQSVVIAVEGNDEIEFERYAPEALANLSGEEVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVITIGRLFATGRLNTERVIALGGSQVNKPRLLRTVLGAKVSQITAGELVDTDNRVISGSVLNGAITQGAHDYLGRYHNQISVIEEGRSKELFGWVAPQPDKYSITRTTLGHFLKNKLFKFNTAVNGGDRAMVPIGTYERVMPLDILPTLLLRDLIVGDTDSAQALGCLELDEEDLALCSFVCPGKYEYGPLLRKVLETIEKEG

SEQ ID NO: 127 - DNA, 1344 bp, Neisseria meningitidis
  misc_feature (125)..(125): N= Unknown
  misc_feature (187)..(187): N= Unknown
  misc_feature (213)..(213): N= Unknown
  misc_feature (348)..(348): N= Unknown
  misc_feature (352)..(352): N= Unknown
  misc_feature (354)..(355): N= Unknown
  misc_feature (357)..(358): N= Unknown
  misc_feature (398)..(398): N= Unknown
  misc_feature (477)..(477): N= Unknown
  misc_feature (512)..(512): N= Unknown
  misc_feature (516)..(516): N= Unknown
  misc_feature (529)..(529): N= Unknown
  misc_feature (532)..(532): N= Unknown
  misc_feature (1296)..(1296): N= Unknown
  misc_feature (1327)..(1327): N= Unknown
atgattaaaatcaaaaaaggtctaaacctgcccatcgcgggcagaccggagcaagtcatttatgacgggcccgtcattaccgaagtcgcgttgcttggcgaagaatatgccggtatgcgcccctngatgaaagtcaaggaaggcgatgccgtcaaaaaaggccaagtgctgtttgaagacaaaaagnatccgggcgtggtgtttaccgcgccngtttcaggcaaaatcgccgccatccatcgcggcgaaaagcgcgtacttcagtcggtcgtgattgccgttgaaggcaacgacgaaatcgagttcgaacgctacgcgcccgaagcgttggcaaacttaagcggcgangaantnngnngcaatctgatccaatccggtttgtggactgcgctgcgtanccgtccgttcagcaaaatccctgccgtcgatgccgagccgttcgccatcttcgtcaatgcgatggacaccaatccgctngcggcagaccctgtggttgtgatcaaagaagccgncgangatttcagacgangtntgctggtattgagccgtttgaccgagcgtaaaatccatgtgtgtaaggcagctggcgcagacgtgccgtctgaaaatgctgccaacatcgaaacacatgaattcggcggcccgcatccggccggtttgagtggcacgcacattcatttcattgagccggtcggtgcaaacaaaaccgtttggaccatcaattatcaagatgtaattgccatcggacgtttgtttgcaacaggccgtctgaacaccgagcgcgtgattgctttgggtggttctcaagtcaacaaaccacgcctcttgcgtaccgttttgggtgcgaaagtatcgcaaattactgcgggcgaattggttgacgcagacaaccgcgtgatttccggttcggtattgaacggcgcgattacacaaggcgcgcacgattatttgggacgctaccacaatcagatttccgttatcgaagaaggccgcagcaaagagctgttcggctgggttgcgccgcagccggacaaatactccatcacgcgtacgaccctcggccatttcctgaaaaacaaactcttcaagttcacgacagccgtcaacggtggcgaccgcgccatggtgccgattggtacttacgagcgcgtaatgccgctagacatcctgcctaccctgcttttgcgcgatttaatcgtcggcgataccgacagcgcgcaagcattgggttgcttggaattggacgaagaagacctcgctttgtgcagcttcgtctgcccgggcaaatacgaatanggcccgctgttgcgtaaggtgctggaaaccnttgagaaggaaggctga

SEQ ID NO: 128 - protein, 447 aa, Neisseria meningitidis
  misc_feature (42)..(42): Xaa= any amino acid
  misc_feature (63)..(63): Xaa= any amino acid
  misc_feature (116)..(116): Xaa= any amino acid
  misc_feature (118)..(120): Xaa= any amino acid
  misc_feature (133)..(133): Xaa= any amino acid
  misc_feature (171)..(172): Xaa= any amino acid
  misc_feature (177)..(178): Xaa= any amino acid
  misc_feature (432)..(432): Xaa= any amino acid
  misc_feature (443)..(443): Xaa= any amino acid
MIKIKKGLNLPIAGRPEQVIYDGPVITEVALLGEEYAGMRPXMKVKEGDAVKKGQVLFEDKKXPGVVFTAPVSGKIAAIHRGEKRVLQSVVIAVEGNDEIEFERYAPEALANLSGXEXXXNLIQSGLWTALRXRPFSKIPAVDAEPFAIFVNAMDTNPLAADPVVVIKEAXXDFRRXXLVLSRLTERKIHVCKAAGADVPSENAANIETHEFGGPHPAGLSGTHIHFIEPVGANKTVWTINYQDVIAIGRLFATGRLNTERVIALGGSQVNKPRLLRTVLGAKVSQITAGELVDADNRVISGSVLNGAITQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEXGPLLRKVLETXEKEG

SEQ ID NO: 129 - DNA, 8 bp, Neisseria gonorrhoeae
  misc_feature (1)..(8): N= Unknown
nnnnnnnn

SEQ ID NO: 130 - protein, 322 aa, Neisseria gonorrhoeae
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHN

SEQ ID NO: 131 - DNA, 1344 bp, Neisseria gonorrhoeae
atgattaaaatcaaaaaaggtctaaatctgcccatcgcgggcagaccggagcaagtcatttatgacggcccggccattaccgaagtcgcgttgcttggcgaagaatatgtcggcatgcgcccctcgatgaaaatcaaggaaggtgaagccgtcaaaaaaggccaagtgctgtttgaagacaaaaagaatccgggcgtagtatttactgcgccggcttcaggcaaaatcgccgctattcaccgtggcgaaaagcgcgtacttcagtcagtcgtgattgccgttgaaggcaacgacgaaatcgagttcgaacgctacgtacctgaagcgctggcaaaattgagcagcgaaaaagtgcgccgcaacctgattcaatcaggcttatggactgcgcttcgcacccgtccgttcagcaaaatccctgccgtagatgccgagccgttcgccatcttcgtcaatgcgatggacaccaatccgctggctgccgaccctacggtcatcatcaaagaagccgccgaagacttcaaacgcggcctgttggtattgagccgcctgaccgaacgtaaaatccatgtgtgtaaagcagcaggcgcagacgtgccgtctgaaaatgctgccaatatcgaaacacatgaatttggcggcccgcatcctgccggcttgagtggcacgcacattcatttcatcgagccagtcggcgcgaataaaaccgtgtggaccatcaattatcaagacgtgattgctatcggacgtttgttcgtaacaggccgtctgaataccgagcgcgtggttgccttgggcggcctgcaagtcaacaaaccgcgcctcttgcgtaccgttttgggtgcgaaggtgtctcaacttaccgccggcgaattggttgacgcggacaaccgcgtgatttccggttcggtattgaacggtgcgattgcacaaggcgcgcatgattatttgggacgctaccacaatcagatttccgttatcgaagaaggccgcagcaaagagctgttcggctgggttgcgccgcagccggacaaatactccatcacgcgcaccactctcggccatttcctaaaaaacaaactcttcaagttcacgacagccgtcaacggcggcgaccgcgccatggtaccgatcggcacttatgagcgcgtaatgccgttggacatcctgcctaccttgcttttgcgcgatttaatcgtcggcgataccgacagcgcgcaggctttgggttgcttggaattggacgaagaagacctcgctttgtgcagcttcgtctgcccgggcaaatacgaatacggcccgctgttgcgcaaagtgctggaaaccattgagaaggaaggctga

SEQ ID NO: 132 - protein, 447 aa, Neisseria gonorrhoeae
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEYGPLLRKVLETIEKEG

SEQ ID NO: 133 - DNA, 961 bp, Neisseria meningitidis
  misc_feature (4)..(4): N= Unknown
  misc_feature (7)..(7): N= Unknown
  misc_feature (23)..(23): N= Unknown
gcgncgnaaatcatccatccccnacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgmyggccgaatcgatgagtactctggsgctttmtttgswcakcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgrkcmmmtacaaaaaagatgcgggcgtgggtacgctgattwctatgatgttgccgtattccgctttcttcttgattgcgtggattgccttattctgcatttgggtatttgttttgggcctgcccgtcggtcccggcgcgcccacattctatcccgcaccttaa

SEQ ID NO: 134 - protein, 320 aa, Neisseria meningitidis
  misc_feature (2)..(3): Xaa=  any amino acid
  misc_feature (8)..(9): Xaa=  any amino acid
  misc_feature (145)..(145): Xaa=  any amino acid
  misc_feature (153)..(153): Xaa=  any amino acid
  misc_feature (155)..(155): Xaa=  any amino acid
  misc_feature (157)..(158): Xaa=  any amino acid
  misc_feature (268)..(269): Xaa=  any amino acid
  misc_feature (281)..(281): Xaa=  any amino acid
AXXIIHPXXVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAXAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVXXYKKDAGVGTLIXMMLPYSAFFLIAWIALFCIWVFVLGLPVGPGAPTFYPAP

SEQ ID NO: 135 - DNA, 1569 bp, Neisseria meningitidis
atgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 136 - protein, 522 aa, Neisseria meningitidis
MSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 137 - DNA, 1569 bp, Neisseria meningitidis
atgagtcaaaccgatacgcaacgggacggacgatttttacgcacagtcgaatggctgggcaatatgttgccgcacccggttacgctttttattattttcattgtgttattgctgattgcctctgccgccggtgcgtatttcggactatccgtccccgatccgcgccctgttggtgcgaaaggacgtgccgatgacggtttgattcacgttgtcagcctgctcgatgctgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatctccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcgacattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcaattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 138 - protein, 522 aa, Neisseria meningitidis
MSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 139 - DNA, 1569 bp, Neisseria gonorrhoeae
atgagtcaaaccgacgcgcgtcgtagcggacgatttttacgcacagtcgaatggctgggcaatatgttgccgcacccggttacgctttttattattttcattgtgttattgctgattgcctctgccgtcggtgcgtatttcggactatccgtccccgatccgcgtcctgttggggcgaaaggacgtgccgatgacggtttgattcacgttgtcagcctgctcgatgccgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatccccacgcaaactcactacttttatggttgtttttacagggattttatccaatacggcttctgaattgggctatgtcgtcctaatccctttgtccgccgtcatctttcattcgctcggccgccatccgcttgccggtttggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggcagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggcaggcgtggtgtttgttgccttatccgccctattggcttggagcatcgtccctgccgacggtattttgcgtcatcctgaaacaggattggttgccggttcgccgtttttaaaatcgattgttgtttttattttcttgttgtttgcgctgccgggcattgtttatggccggataacccgaagtttgcgcggcgaacgggaagtcgttaatgcgatggccgaatcgatgagtactttgggactttatttggtcatcatcttttttgccgcacagtttgtcgcattttttaattggacgaatattgggcaatatattgccgttaaaggggcggtgttcttaaaagaagtcggcttgggcggcagtgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtaatcaaatacaaaaaagatgcgggcgtaggcacgctgatttctatgatgttgccgtattccgctttcttcttaattgcatggatcgccttattctgcatttgggtatttgttttgggtctgcccgtcggtcccggcacacccacattctatccggtgccttaa

SEQ ID NO: 140 - protein, 522 aa, Neisseria gonorrhoeae
MSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKKFRLGGSVLFIGFILICAFINLMIGSASAQWAVTAPIFVPMLMLAGNAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 141 - DNA, 503 bp, Neisseria meningitidis
  misc_feature (20)..(20): N= Unknown
  misc_feature (22)..(22): N= Unknown
  misc_feature (459)..(459): N= Unknown
acagccggcgcagcaggttncncggtcttcgttttcgtaacggacagtcaggtggaggtgttcgggaacatccagaccgcagtggaaacaggtttttttcatggcatttcggtttcgtctgtgtttggtgcggcggcacaagactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatygctnacgaatccgacggtatcggtcaggataatgctgcattcgggact

SEQ ID NO: 142 - protein, 167 aa, Neisseria meningitidis
  misc_feature (7)..(8): Xaa= any amino acid
  misc_feature (152)..(152): Xaa= any amino acid
TAGAAGXXVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRXLTNPTVSVRIMLHSG

SEQ ID NO: 143 - DNA, 1149 bp, Neisseria meningitidis
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgactgcctgacaaccggcgcagcaggtttcgcggtcttcgttttcgtaacggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatcgctgacgaatccgacggtatcggtcaggataatgctgcattcgggactgatgtacagccgccgcgccgtcgtgtcgagtgtggcgaaaagctggtctttcgcatatatgcccgacttggtcagccggttgaacagactggatttgccgacattggtatag

SEQ ID NO: 144 - protein, 381 aa, Neisseria meningitidis
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDCLTTGAAGFAVFVFVTDGQMQVFGNVQPAVETGFFHGISVSSVFGAAAQYSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRSLTNPTVSVRIMLHSGLMYSRRAVVSSVAKSWSFAYMPDLVSRLNRLDLPTLV

SEQ ID NO: 145 - DNA, 8 bp, Neisseria gonorrhoeae
  misc_feature (1)..(8): N= Unknown
nnnnnnnn

SEQ ID NO: 146 - protein, 382 aa, Neisseria gonorrhoeae
MEDLQEIGFDVAAVKVGRQREHHRLHHTQSGNGKADDVLFAFFLVGGFDFLRVIGCGGVACLPDFQQNVGEADFAVVPDDAAAVRAVIEVDADDAVCAQKLLFDQPDAGGAGNAAEHQHCFVRAIMGFHKVGLDFGQVVQADLVEDFLGRQFGFFRVGGASFVITAQAGIDDALCDCLTADAAGFAVFAFVADGQMQVFGNVQPAVETGFFHGISVSSVFGAAAQYSAMASRSASIPVFSATEMRTAAIFPAASRHMPVFCSSDGSRSVLLYTLMHGISWAWISCSTFSTSSICCPLFRAAASTTCSSTSACTVSSKVAEKAEISLCGRSLTNPTVSVRIMLHAGLMYSRRAVVSRVAKSWSFAYMPDLVSRLNRLDLPTLV

SEQ ID NO: 147 - DNA, 542 bp, Neisseria meningitidis
  misc_feature (38)..(38): N= Unknown
  misc_feature (254)..(254): N= Unknown
  misc_feature (356)..(356): N= Unknown
  misc_feature (458)..(458): N= Unknown
ggccattactccgaccgcacttggaagccgcgtttggncggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaantacgcctacgggattcaaagtttcttagcaaatacgggcgcggtcgtggcggcgattctgccgtttgtgtttgcgtatatcggtttggcgaacaccgccganaaaggcgttgtgccgcagaccgtggtcgtggcgttttatgtgggtgcggcgttgctggtgattaccagcgcgttcacgattttcaaagtgaaggaatacganccggaaacctacgcccgttaccacggcatcgatgtcgccgcgaatcaggaaaaagccaactggatcgcactcttaaaaccgcgc

SEQ ID NO: 148 - protein, 181 aa, Neisseria meningitidis
  misc_feature (13)..(13): Xaa= any amino acid
  misc_feature (85)..(85): Xaa= any amino acid
  misc_feature (119)..(119): Xaa= any amino acid
  misc_feature (153)..(153): Xaa= any amino acid
  misc_feature (180)..(180): Xaa= any amino acid
GHYSDRTWKPRLXGRRLPYLLYGTLIAVIVMILMPNSGSFGFGYASLAALSFGALMIALLDVSSNMAMQPFKMMVGDMVNEEQKXYAYGIQSFLANTGAVVAAILPFVFAYIGLANTAXKGVVPQTVVVAFYVGAALLVITSAFTIFKVKEYXPETYARYHGIDVAANQEKANWIALLKXA

SEQ ID NO: 149 - DNA, 1356 bp, Neisseria meningitidis
atgtcggaatatacgcctcaaacagcaaaacaaggtttgcccgcgctggcaaaaagcacgatttggatgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 150 - protein, 451 aa, Neisseria meningitidis
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 151 - DNA, 1356 bp, Neisseria meningitidis
atgtcggaatatacgcctcaaacagcaaaacaaggtttgcccgcgctggcaaaaagcacgatttggatgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 152 - protein, 451 aa, Neisseria meningitidis
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 153 - DNA, 1020 bp, Neisseria gonorrhoeae
atgataggggatcgccgcgccggcaaccatttcggattttccaaagcaaatacttttcaaatcaaaaaaaaggatttactttatgtcggaatatacgcctcaaacagcaaaacaaggtttgcccgcgccggcaaaaagcacgatttggatgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtag

SEQ ID NO: 154 - protein, 339 aa, Neisseria gonorrhoeae
MIGDRRAGNHFGFSKANTFQIKKKDLLYVGIYASNSKTRFARAGKKHDLDVELRLSRRSDGLYPAKLADEPHFSNARRRPAQFGLVFHPAAAGGDAGSADSGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAV

SEQ ID NO: 155 - DNA, 358 bp, Neisseria meningitidis
  misc_feature (111)..(111): N= Unknown
  misc_feature (122)..(122): N= Unknown
  misc_feature (138)..(138): N= Unknown
  misc_feature (140)..(140): N= Unknown
  misc_feature (243)..(243): N= Unknown
  misc_feature (251)..(251): N= Unknown
  misc_feature (259)..(259): N= Unknown
  misc_feature (291)..(291): N= Unknown
  misc_feature (344)..(344): N= Unknown
atgttgttccgtaaaacgaccgccgccgttttggcgcataccttgatgctgaacggctgtacgttgatgttgtggggaatgaacaacccggtcagcgaaacaatcacccgnaaacacgttgncaaagaccaaatccgngncttcggtgtggttgccgaagacaatgcccaattggaaaagggcagcctggtgatgatgggcggaaaatactggttcgtcgtcaatcccgaagattcggcgaantgacgggnattttganggcagggctggacaaacccttccaaatagttnaggataccccgagctatgctgccaccaagccctgccggtcaaactcggatcgnctggcagccagaat

SEQ ID NO: 156 - protein, 120 aa, Neisseria meningitidis
  misc_feature (41)..(41): Xaa= any amino acid
  misc_feature (47)..(47): Xaa= any amino acid
  misc_feature (81)..(82): Xaa= any amino acid
  misc_feature (87)..(87): Xaa= any amino acid
  misc_feature (98)..(98): Xaa= any amino acid
  misc_feature (104)..(104): Xaa= any amino acid
  misc_feature (116)..(116): Xaa= any amino acid
MLFRKTTAAVLAHTLMLNGCTLMLWGMNNPVSETITRKHVXKDQIRXFGVVAEDNAQLEKGSLVMMGGKYWFVVNPEDSAXXTGILXAGLDKPFQIVXDTPSYXCHQALPVKLGSXGSQN

SEQ ID NO: 157 - DNA, 717 bp, Neisseria meningitidis
atgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatga

SEQ ID NO: 158 - protein, 238 aa, Neisseria meningitidis
MLFRKTTAAVLAATLMLNGCTLMLWGMNNPVSETITRKHVDKDQIRAFGVVAEDNAQLEKGSLVMMGGKYWFVVNPEDSAKLTGILKAGLDKPFQIVEDTPSYARHQALPVKLESPGSQNFSTEGLCLRYDTDKPADIAKLKQLGFEAVKLDNRTIYTRCVSAKGKYYATPQKLNADYHFEQSVPADIYYTVTEEHTDKSKLFANILYTPPFLILDAAGAVLALPAAALGAVVDAARK

SEQ ID NO: 159 - DNA, 714 bp, Neisseria meningitidis
atgttgttccgtaaaacgaccgccgccgttttggcggcaaccttgatgttgaacggctgtacggtaatgatgtggggtatgaacagcccgttcagcgaaacgaccgcccgcaaacacgttgacaaggaccaaatccgcgccttcggtgtggttgccgaagacaatgcccaattggaaaagggcagcctggtgatgatgggcgggaaatactggttcgtcgtcaatcctgaagattcggcgaagctgacgggcattttgaaggccgggttggacaagcagtttcaaatggttgagcccaacccgcgctttgcctaccaagccctgccggtcaaactcgaatcgcccgccagccagaatttcagtaccgaaggcctttgcctgcgctacgataccgacagacctgccgacatcgccaagctgaaacagcttgagtttgaagcggtcgaactcgacaatcggaccatttacacgcgctgcgtctccgccaaaggcaaatactacgccacaccgcaaaaactgaacgccgattatcattttgagcaaagtgtgcctgccgatatttattacacggttacgaaaaaacataccgacaaatccaagttgtttgaaaatattgcatatacgcccaccacgttgatactggatgcggtgggcgcggtgctggccttgcctgtcgcggcgttgattgcagccacgaattcctcagacaaatga

SEQ ID NO: 160 - protein, 237 aa, Neisseria meningitidis
MLFRKTTAAVLAATLMLNGCTVMMWGMNSPFSETTARKHVDKDQIRAFGVVAEDNAQLEKGSLVMMGGKYWFVVNPEDSAKLTGILKAGLDKQFQMVEPNPRFAYQALPVKLESPASQNFSTEGLCLRYDTDRPADIAKLKQLEFEAVELDNRTIYTRCVSAKGKYYATPQKLNADYHFEQSVPADIYYTVTKKHTDKSKLFENIAYTPTTLILDAVGAVLALPVAALIAATNSSDK

SEQ ID NO: 161 - DNA, 714 bp, Neisseria gonorrhoeae
atgttgttccgtaaaacgaccgccgccgttttggcggcaaccttgatactgaacggctgtacgatgatgttgcgggggatgaacaacccggtcagccaaacaatcacccgcaaacacgttgacaaagaccaaatccgcgccttcggtgtggttgccgaagacaatgcccaattggaaaagggcagcctggtgatgatgggcgggaaatactggttcgccgtcaatcccgaagattcggcgaagctgacgggccttttgaaggccgggttggacaagcccttccaaatagttgaggataccccgagctatgcccgccaccaagccctgccggtcaaattcgaagcgcccggcagccagaatttcagtaccggaggtctttgcctgcgctatgataccggcagacctgacgacatcgccaagctgaaacagcttgagtttaaagcggtcaaactcgacaatcggaccatttacacgcgctgcgtatccgccaaaggcaaatactacgccacgccgcaaaaactgaacgccgattatcattttgagcaaagtgtgcccgccgatatttattatacggttactgaaaaacataccgacaaatccaagctgtttggaaatatcttatatacgccccccttgttgatattggatgcggcggccgcggtgctggtcttgcctatggctctgattgcagccgcgaattcctcagacaaatga

SEQ ID NO: 162 - protein, 237 aa, Neisseria meningitidis
MLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 163 - DNA, 374 bp, Neisseria meningitidis
gtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacatggtcggaaatccatccggaggatgaatatgacgggccgcaagcagcgattatccgccccccggaggagcaagggatatatacagctattatgtcaaaggaacttcaacaaaaacaaagactagtattgtccctcaagccccattttcagaccgttggctagaagaaaatgccggtgccgcctctggt

SEQ ID NO: 164 - protein, 125 aa, Neisseria meningitidis
  misc_feature (79)..(79): Xaa= any amino acid
VSPVLPITHERTGFEGVIGYETHFSGHGHEVHSPFDHHDSKSTSDFSGGVDGGFTVYQLHRTWSEIHPEDEYDGPQAAXYPPPGGARDIYSYYVKGTSTKTKTSIVPQAPFSDRWLEENAGAASG

SEQ ID NO: 165 - DNA, 1452 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatga

SEQ ID NO: 166 - protein, 483 aa, Neisseria meningitidis
MNLPIQKFMMLFAAAISLLQIPISHANGLDARLRDDMQAKHYEPGGKYHLFGNARGSVKKRVYAVQTFDATAVSPVLPITHERTGFEGVIGYETHFSGHGHEVHSPFDHHDSKSTSDFSGGVDGGFTVYQLHRTGSEIHPEDGYDGPQGSDYPPPGGARDIYSYYVKGTSTKTKTNIVPQAPFSDRWLKENAGAASGFFSRADEAGKLIWESDPNKNWWANRMDDVRGIVQGAVNPFLMGFQGVGIGAITDSAVSPVTDTAAQQTLQGINDLGKLSPEAQLAAASLLQDSAFAVKDGINSAKQWADAHPNITATAQTALSAAEAAGTVWRGKKVELNPTKWDWVKNTGYKKPAARHMQTLDGEMAGGNKPIKSLPNSAAEKRKQNFEKFNSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 167 - DNA, 1449 bp, Neisseria meningitidis
  misc_feature (8)..(8): N= Unknown
  misc_feature (53)..(53): N= Unknown
  misc_feature (66)..(66): N= Unknown
  misc_feature (488)..(489): N= Unknown
  misc_feature (492)..(492): N= Unknown
  misc_feature (807)..(807): N= Unknown
  misc_feature (822)..(822): N= Unknown
  misc_feature (969)..(969): N= Unknown
  misc_feature (1041)..(1041): N= Unknown
  misc_feature (1050)..(1050): N= Unknown
  misc_feature (1193)..(1197): N= Unknown
  misc_feature (1306)..(1306): N= Unknown
  misc_feature (1351)..(1351): N= Unknown
  misc_feature (1365)..(1365): N= Unknown
atgaattngcctattcaaaaattcatgatgctgtttgcagcagcaatatcgtngctgcaaatcccnattagtcatgcgaacggtttggatgcccgtttgcgcgatgatatgcaggcaaaacactacgaaccgggtggtaaataccatctgtttggtaatgctcgcggcagtgttaaaaatcgggtttacgccgtccaaacatttgatgcaactgcggtcggccccatactgcctattacacacgaacggacaggatttgaaggcattatcggttatgaaacccatttttcaggacatggacatgaagtacacagtccgttcgataatcatgattcaaaaagcacttctgatttcagcggcggcgtagacggtggttttaccgtttaccaacttcatcggacagggtcggaaatccatccggaggatggatatgacgggccgcaaggcagcgattatccgccccccggaggagcaagggatatatacanntantatgtcaaaggaacttcaacaaaaacaaagagtaatattgttccccgagccccattttcagaccgctggctaaaagaaaatgccggtgccgcctctggttttttcagccgtgctgatgaagcaggaaaactgatatgggaaagcgaccccaataaaaattggtgggctaaccgtatggatgatattcgcggcatcgtccaaggtgcggttaatccttttttaatgggttttcaaggagtagggattggggcaattacagacagtgcagtaagcccggtcacagatacagccgcgcagcagactctacaaggtatnaatcatttaggaaanttaagtcccgaagcacaacttgcggctgcaaccgcattacaagacagtgcttttgcggtaaaagacggtatcaattccgccagacaatgggctgatgcccatccgaatataactgcaacagcccaaactgcccttgccgtagcagangccgcaactacggtttggggcggtaaaaaagtagaacttaacccgaccaaatgggattgggttaaaaatacnggctataanacacctgctgttcgcaccatgcatactttggatggggaaatggccggtgggaatagaccgcctaaatctataacgtccaacagcaaagcagatgcttccacacaaccgtctttacaagcgcaactaattggagaacaaattannnnngggcatgcttataacaagcatgtcataagacaacaagaatttacggatttaaatatcaattcaccagcagattttgctcggcatattgaaaatattgttagccatccancaaatatgaaagagttacctcgcggtagaactgcgtattgggatnataaaacagggacnatagttatccgagataaaaattctgacgatggaggtacagcatttagaccaacatcaggtaaaaaatattatgatgatttatag

SEQ ID NO: 168 - protein, 482 aa, Neisseria meningitidis
  misc_feature (3)..(3): Xaa= any amino acid
  misc_feature (18)..(18): Xaa= any amino acid
  misc_feature (163)..(164): Xaa= any amino acid
  misc_feature (269)..(269): Xaa= any amino acid
  misc_feature (274)..(274): Xaa= any amino acid
  misc_feature (323)..(323): Xaa= any amino acid
  misc_feature (350)..(350): Xaa= any amino acid
  misc_feature (398)..(399): Xaa= any amino acid
  misc_feature (436)..(436): Xaa= any amino acid
  misc_feature (451)..(451): Xaa= any amino acid
MNXPIQKFMMLFAAAISXLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYXXYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGXNHLGXLSPEAQLAAATALQDSAFAVKDGINSARQWADAHPNITATAQTALAVAXAATTVWGGKKVELNPTKWDWVKNTGYXTPAVRTMHTLDGEMAGGNRPPKSITSNSKADASTQPSLQAQLIGEQIXXGHAYNKHVIRQQEFTDLNINSPADFARHIENIVSHPXNMKELPRGRTAYWDXKTGTIVIRDKNSDDGGTAFRPTSGKKYYDDL

SEQ ID NO: 169 - DNA, 8 bp, Neisseria gonorrhoeae
  misc_feature (1)..(8): N= Unknown
nnnnnnnn

SEQ ID NO: 170 - protein, 468 aa, Neisseria gonorrhoeae
MNLPIQKFMMLFAAAISLLQIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPEDGYDGPQGGGYPPPGGARDIYSYHIKGTSTKTKINTVPQAPFSDRWLKENAGAASGFLSRADEAGKLIWENDPDKNWRANRMDDIRGIVQGAVNPFLTGFQGLGVGAITDSAVSPVTYAAARKTLQGIHNLGNLSPEAQLAAATALQDSAFAVKDSINSARQWADAHPNITATAQTALAVTEAATTVWGGKKVELNPAKWDWVKNTGYKKPAARHMQTVDGEMAGGNKPLESKNTVTTNNFFENTGYTEKVLRQASNGDYHGFPQSVDAFSENGTVIQIVGGDNIVRHKLYIPGSYKGKDGNFEYIREADGKINHRLFVPNQQLPEK

SEQ ID NO: 171 - DNA, 1497 bp, Neisseria gonorrhoeae
atgaatttgcctattcaaaaattcatgatgctgttggcagcggcaatatcgatgctgcatatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatacatcccgcagacggatatgacgggcctcaaggcggcggttatccggaaccacaaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaatttaagtccggaagcacaacttgccgccgcgagcctattacaggacagtgcctttgcggtaaaagacggcatcaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctataaaaaacctgctgcccgccatatgcagactgtagatggggagatggcaggggggaatagaccgcctaaatctataacgtcggaaggaaaagctaatgctgcaacctatcctaagttggttaatcagctaaatgagcaaaacttaaataacattgcggctcaagatccaagattgagtctagctattcatgagggtaaaaaaaattttccaataggaactgcaacttatgaagaggcagatagactaggtaaaatttgggttggtgagggtgcaagacaaactagtggaggcggatggttaagtagagatggcactcgacaatatcggccaccaacagaaaaaaaatcacaatttgcaactacaggtattcaagcaaattttgaaacttatactattgattcaaatgaaaaaagaaataaaattaaaaatggacatttaaatattaggtaa

SEQ ID NO: 172 - protein, 498 aa, Neisseria gonorrhoeae
MNLPIQKFMMLLAAAISMLHIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 173 - DNA, 126 bp, Neisseria meningitidis
atgaaaaaacaaatcaccgcagccgtaatgatgctgtctatgattgcccccgcaatggcaaacggcttggacaatcaggcatttgaagaccaaatgttccacacgcgggcagatgcaccgatgcag

SEQ ID NO: 174 - protein, 42 aa, Neisseria meningitidis
MKKQITAAVMMLSMIAPAMANGLDNQAFEDQMFHTRADAPMQ

SEQ ID NO: 175 - DNA, 546 bp, Neisseria meningitidis
atgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaaggagacagagggggcgtttcttccattggctatcttgggtggtgctgccattggtatgtggacacagcatggttttagttatgcaacgacaggcagaccagcttctgttagagatgttgctattgctggcggattaggcgcaattcctggtggtgtaggcgccgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 176 - protein, 181 aa, Neisseria meningitidis
MKKQITAAVMMLSMIAPAMANGLDNQAFEDQVFHTRADAPMQLAELSQKEMKETEGAFLPLAILGGAAIGMWTQHGFSYATTGRPASVRDVAIAGGLGAIPGGVGAAGKVVSFAKYGREIKIGNNMRIAPFGNRTGHPIGKFPHYHRRVTDNTGKTLPGQGIGRHRPWESKSTDRSWKNRF

SEQ ID NO: 177 - DNA, 546 bp, Neisseria meningitidis
  misc_feature (159)..(159): N= Unknown
  misc_feature (164)..(164): N= Unknown
  misc_feature (185)..(185): N= Unknown
  misc_feature (308)..(308): N= Unknown
  misc_feature (420)..(420): N= Unknown
atgaaaaaacaaatcaccgcagccgtaatgatgctgtctatgattgcccccgcaatggcaaacggcttggacaatcaggcatttgaagaccaagtgttccacacgcgggcagatgcaccgatgcagttggcggagctttctcaaaaggagatgaagganacagngggggcgtttcttccattggntatcttgggtggtgctgccattggtatgtggacacagcatggttttagttatgcaacgacaggcagaccagcttctgttagagatgttgctattgctggcggattaggcgcaattcctggtgntgtaggcgccgcaggaaaggttgtttcctttgctaaatatggacgtgagattaaaatcggcaataatatgcggatagcccctttcggtaatagaacaggtcatcctattggnaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 178 - protein, 181 aa, Neisseria meningitidis
  misc_feature (53)..(53): Xaa= any amino acid
  misc_feature (55)..(55): Xaa= any amino acid
  misc_feature (62)..(62): Xaa= any amino acid
  misc_feature (103)..(103): Xaa= any amino acid
MKKQITAAVMMLSMIAPAMANGLDNQAFEDQVFHTRADAPMQLAELSQKEMKXTXGAFLPLXILGGAAIGMWTQHGFSYATTGRPASVRDVAIAGGLGAIPGXVGAAGKVVSFAKYGREIKIGNNMRIAPFGNRTGHPIGKFPHYHRRVTDNTGKTLPGQGIGRHRPWESKSTDRSWKNRF

SEQ ID NO: 179 - DNA, 540 bp, Neisseria meningitidis
atgaaaaaacaaatcaccgcagccgtaatgatgctgtctatgatcgcccccgcaatggcaaacggattggacaatcaggcatttgaagaccaagtgttccacacgcgggcagatgcgccgatgcagttggcggagctttctcagaaggagatgaaggagactgaaggggcttttcttccattggctatcttgggtggtgctgccattggtatgtggacacagcatggttttagttatgcaacgacaggcagaccagcttctgttagagatgttgctggcggattaggcgcaattcctggtgatgtaggtgctgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttctaa

SEQ ID NO: 180 - protein, 179 aa, Neisseria gonorrhoeae
MKKQITAAVMMLSMIAPAMANGLDNQAFEDQVFHTRADAPMQLAELSQKEMKETEGAFLPLAILGGAAIGMWTQHGFSYATTGRPASVRDVAGGLGAIPGDVGAAGKVVSFAKYGREIKIGNNMRIAPFGNRTGHPIGKFPHYHRRVTDNTGKTLPGQGIGRHRPWESKSTDRSWKNRF

SEQ ID NO: 181 - DNA, 251 bp, Neisseria meningitidis
atgaataaaactctctatcgtgtaattttcaaccgcaaacgtggggctgtgrtagccgttgctgaaactaccaagcgcgaaggtaaaagctgtgccgatagtgattcaggcagcgctcatgtgaaatctgttccttttggtactactcatgcacctgtttgtgcgttacaaatatcttttctttttctttattgggcttttctttatgtttggctgtaggtacggycaatattgcttttgctgatggcatt

SEQ ID NO: 182 - protein, 84 aa, Neisseria meningitidis
  misc_feature (18)..(18): Xaa= any amino acid
  misc_feature (55)..(55): Xaa= any amino acid
  misc_feature (76)..(76): Xaa= any amino acid
MNKTLYRVIFNRKRGAVXAVAETTKREGKSCADSDSGSAHVKSVPFGTTHAPVCXVTNIFSFSLLGFSLCLAVGTXNIAFADGI

SEQ ID NO: 183 - DNA, 249 bp, Neisseria meningitidis
atgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcatt

SEQ ID NO: 184 - protein, 83 aa, Neisseria meningitidis
MNKTLYRVIFNRKRGAVVAVAETTKREGKSCADSDSGSAHVKSVPFGTTHAPVCRSNIFSFSLLGFSLCLAVGTANIAFADGI

SEQ ID NO: 185 - protein, 792 aa, Neisseria gonorrhoeae
ATGAACAAAACCCTCTATCGTGTGATTTTCAACCGCAAACGCGGTGCTGTGGTAGCTGTTGCCGAAACCACCAAGCGCGAAGGTAAAAGCTGTGCCGATAGTGGTTCGGGCAGCGTTTATGTGAAATCCGTTTCTTTCATTCCTACTCATTCCAAAGCCTTTTGTTTTTCTGCATTAGGCTTTTCTTTATGTTTGGCTTTGGGTACGGTCAATATTGCTTTTGCTGACGGCATTATTACTGATAAAGCTGCTCCTAAAACCCAACAAGCCACGATTCTGCAAACAGGTAACGGCATACCGCAAGTCAATATTCAAACCCCTACTTCGGCAGGGGTTTCTGTTAATCAATATGCCCAGTTTGATGTGGGTAATCGCGGGGCGATTTTAAACAACAGTCGCAGCAACACCCAAACACAGCTAGGCGGTTGGATTCAAGGCAATCCTTGGTTGACAAGGGGCGAAGCACGTGTGGTTGTAAACCAAATCAACAGCAGCCATCCTTCACAACTGAATGGCTATATTGAAGTGGGTGGACGACGTGCAGAAGTCGTTATTGCCAATCCGGCAGGGATTGCAGTCAATGGTGGTGGTTTTATCAATGCTTCCCGTGCCACTTTGACGACAGGCCAACCGCAATATCAAGCAGGAGACTTTAGCGGCTTTAAGATAAGGCAAGGCAATGCTGTAATCGCCGGACACGGTTTGGATGCCCGTGATACCGATTTCACACGTATTCTTGTATGCCAACAAAATCACCTTGATCAGTACGGCCGAACAAGCAGGCATTCGTAA

SEQ ID NO: 186 - protein, 263 aa, Neisseria gonorrhoeae
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILVCQQNHLDQYGRTSRHS

SEQ ID NO: 187 - DNA, 243 bp, Neisseria meningitidis
atgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcg

SEQ ID NO: 188 - protein, 81 aa, Neisseria meningitidis
MNTPPFVCWIFCKVIDNFGDIGVSWRLARVLHRELGWQVHLWTDDVSALRALCPDLPDVPCVHQDIHVRTWHSDAADIDTA

SEQ ID NO: 189 - DNA, 1149 bp, Neisseria meningitidis
atgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctag

SEQ ID NO: 190 - protein, 383 aa, Neisseria meningitidis
MNTPPFVCWIFCKVIDNFGDIGVSWRLARVLHRELGWQVHLWTDDVSALRALCPDLPDVPCVHQDIHVRTWHSDAADIDTAPVPDVVIETFACDLPENVLHIIRRHKPLWLNWEYLSAEESNERLHLMPSPQEGVQKYFWFMGFSEKSGGLIRERDYCEAVRFDTEALRERLMLPEKNASEWLLFGYRSDVWAKWLEMWRQAGSPMTLLLAGTQIIDSLKQSGVIPQDALQNDGDVFQTASVRLVKIPFVPQQDFDQLLHLADCAVIRGEDSFVRAQLAGKPFFWHIYPQDENVHLDKLHAFWDKAHGFYTPETVSAHRRLSDDLNGGEALSATQRLECWQTLQQHQNGWRQGAEDWSRYLFGQPSAPEKLAAFVSKHQKIRW

SEQ ID NO: 191 - DNA, 1149 bp, Neisseria meningitidis
  misc_feature (28)..(28): N= Unknown
  misc_feature (179)..(179): N= Unknown
  misc_feature (251)..(251): N= Unknown
  misc_feature (336)..(336): N= Unknown
  misc_feature (360)..(360): N= Unknown
  misc_feature (379)..(379): N= Unknown
  misc_feature (407)..(407): N= Unknown
  misc_feature (414)..(414): N= Unknown
  misc_feature (439)..(441): N= Unknown
  misc_feature (536)..(536): N= Unknown
  misc_feature (633)..(633): N= Unknown
  misc_feature (642)..(642): N= Unknown
atgaatactcctcctttttctgctgganttttttgcaaggtcatcgacaatttcggcgacatcggcgtttcgtggcggcttgcccgtgttttgcaccgcgaactcggttggcaggtgcatttgtggacggacgatgtgtccgccttgcgtgcgctttgccctgatttgcccgatgttcnctgcgttcatcaggatattcatgtccgcacttggcattccgatgcggcagatattgataccgcgcctgttcncgatgtcgtcatcgaaacttttgcctgcgacctgcccgaaaatgtgctgcacatcatccgccgacacaagccgctttggctgaantgggaatatttgagcgcggagganagcaatgaaaggctgcacntgatgccttcgccgcaggagagtgttcnaaaatanttttggtttatgggtttcagcgaannnagcggcggactgatacgcgaacgcgattactgcgaagccgtccgtttcgatagcggagccttgcgcaagaggctgatgcttcccgaaaaaaacgnccccgaatggctgcttttcggctatcggagcgatgtttgggcaaagtggctggaaatgtggcgacaggcaggcagtccgttgacacttttgctggcnggggcgcanattatcgacagcctcaaacaaaacggcgttattccgcaagatgccctgcaaaacgacggcgatgtttttcagacggcatccgtccgcctcgtcaaaatccctttcgtgccgcaacaggacttcgacaaactgctgcaccttgccgactgcgccgtcatccgcggcgaagacagtttcgtgcgcgcccagcttgcgggcaaacccttcttttggcacatctacccgcaagatgagaatgtccatctcgacaaactccacgccttttgggataaggcacacggtttctacacgcccgaaaccgcatcggcacaccgccgcctttcagacgacctcaacggcggagaggctttatccgcaacacaacgcctcgaatgttggcaaatcctgcaacaacatcaaaacggctggcggcaaggcgcggaggattggagccgttatctttttgggcagccttccgcatccgaaaaactcgccgcctttgtttcaaagcatcaaaaaatacgctag

SEQ ID NO: 192 - protein, 382 aa, Neisseria meningitidis
  misc_feature (10)..(10): Xaa= Unknown
  misc_feature (60)..(60): Xaa= Unknown
  misc_feature (84)..(84): Xaa= Unknown
  misc_feature (112)..(112): Xaa= Unknown
  misc_feature (120)..(120): Xaa= Unknown
  misc_feature (127)..(127): Xaa= Unknown
  misc_feature (136)..(136): Xaa= Unknown
  misc_feature (138)..(138): Xaa= Unknown
  misc_feature (147)..(147): Xaa= Unknown
  misc_feature (179)..(179): Xaa= Unknown
  misc_feature (214)..(214): Xaa= Unknown
MNTPPFSAGXFCKVIDNFGDIGVSWRLARVLHRELGWQVHLWTDDVSALRALCPDLPDVXCVHQDIHVRTWHSDAADIDTAPVXDVVIETFACDLPENVLHIIRRHKPLWLXWEYLSAEXSNERLHXMPSPQESVXKXFWFMGFSEXSGGLIRERDYCEAVRFDSGALRKRLMLPEKNXPEWLLFGYRSDVWAKWLEMWRQAGSPLTLLLAGAXIIDSLKQNGVIPQDALQNDGDVFQTASVRLVKIPFVPQQDFDKLLHLADCAVIRGEDSFVRAQLAGKPFFWHIYPQDENVHLDKLHAFWDKAHGFYTPETASAHRRLSDDLNGGEALSATQRLECWQILQQHQNGWRQGAEDWSRYLFGQPSASEKLAAFVSKHQKIR

SEQ ID NO: 193 - DNA, 8 bp, Neisseria gonorrhoeae
  misc_feature (1)..(8): N= Unknown
nnnnnnnn

SEQ ID NO: 194 - protein, 345 aa, Neisseria gonorrhoeae
MVMNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECGVL

SEQ ID NO: 195 - protein, 1152 aa, Neisseria gonorrhoeae
ATGAATACATACGCTTTTCCTGTCTGTTGGATTTTTTGCAAGGTCATCGACAATTTCGGCGACATCGGCGTTTCGTGGCGGCTCGCCCGTGTTTTGCACCGCGAACTCGGTTGGCAGGTGCATTTGTGGACGGACGACGTGTCCGCCTTGCGCGCGCTTTGTCCCGATTTGCCCGATGTTCCCTTCGTTCATCAGGATATTCATGTCCGCACTTGGCATTCCGATGCGGCAGACATTGATACCGCGCCCGTTCCCGATGCCGTTATCGAAACTTTTGCCTGCGACCTGCCCGAAAATGTGCTGAACATCATCCGCCGACACAAACCGCTTTGGCTGAATTGGGAATATTTGAGCGCGGAGGAAAGCAATGAAAGGCTGCACCTGATGCCTTCGCCGCAGGAGGGCGTTCAAAAATATTTTTGGTTTATGGGTTTCAGCGAAAAAAGCGGCGGGTTGATACGCGAACGCGATTACCGCGAAGCCGTCCGTTTCGATACCGAAGCCCTGCGCCGGCGGCTGGTGCTGCCCGAAAAAAACGCCCCCGAATGGCTGCTTTTCGGCTATCGGGGCGATGTTTGGGCAAAGTGGCTGGACATGTGGCAACAGGCAGGCAGCCTGATGACCCTACTGCTGGCGGGGGCGCAAATTATCGACAGCCTCAAACAAAGCGGCGTTATTCCGCAAAACGCCCTGCAAAATGAAGGCGGTGTCTTTCAGACGGCATCCGTCCGCCTTGTCAAAATCCCGTTCGTGCCGCAACAGGACTTCGACAAATTGCTGCACCTCGCCGACTGCGCCGTGATACGCGGCGAAGACAGTTTCGTGCGTACCCAGCTTGCCGGAAAACCCTTTTTTTGGCACATCTACCCGCAAGACGAGAATGTCCATCTCGACAAACTCCACGCCTTTTGGGATAAGGCATACGGCTTCTACACGCCCGAAACCGCATCGGTGCACCGCCTCCTTTCGGACGACCTCAACGGCGGAGAGGCTTTATCCGCAACACAACGCCTCGAATGTTGGCAAACCCTGCAACAACATCAAAACGGCTGGCGGCAAGGCGCGGAGGATTGGAGCCGTTATCTTTTCGGGCAGCCTTCCGCATCCGAAAAACTCGCCGCCTTTGTTTCAAAGCATCAAAAAATACGCTAG

SEQ ID NO: 196 - protein, 383 aa, Neisseria meningitidis
MNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNEGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECWQTLQQHQNGWRQGAEDWSRYLFGQPSASEKLAAFVSKHQKIR

SEQ ID NO: 197 - DNA, 428 bp, Neisseria meningitidis
  misc_feature (15)..(15): N= Unknown
  misc_feature (59)..(59): N= Unknown
  misc_feature (97)..(97): N= Unknown
  misc_feature (136)..(136): N= Unknown
  misc_feature (394)..(394): N= Unknown
  misc_feature (410)..(410): N= Unknown
ttgttcctgcgtgtnaaagtggggcgttttttcagcagtccggcgacgtggtttcgggncaaagaccctgtaaatcaggcggtgttgcggctgtatncggacgagtggcggcaacttcggtacgttggaaaatagncgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcggtcggtcatcgaaggccgtctgaacggcaatattgccgatgcgcgggcttggtcggggctgctggtcgncagtatcgcctgctanggcatcctgccgcgcctg

SEQ ID NO: 198 - protein, 143 aa, Neisseria meningitidis
  misc_feature (20)..(20): Xaa= any amino acid
  misc_feature (33)..(33): Xaa= any amino acid
  misc_feature (38)..(38): Xaa= any amino acid
  misc_feature (46)..(46): Xaa= any amino acid
  misc_feature (132)..(132): Xaa= any amino acid
  misc_feature (137)..(137): Xaa= any amino acid
LFLRVKVGRFFSSPATWFRXKDPVNQAVLRLYXDEWRXTSVRWKIXATSHSLWLCTLLGMLVSVLLLLLVRQYTFNWESTLLSNAASVRAVEMLAWLPSKLGFPVPDARSVIEGRLNGNIADARAWSGLLVXSIACXGILPRL

SEQ ID NO: 199 - DNA, 1341 bp, Neisseria meningitidis
atgttgaatccatcccgaaaactggttgagctggtccgtattttggacgaaggcggttttattttcagcggcgatcccgtacaggcgacggaggctttgcgccgcgtggacggcagtacggaggaaaaaatcatccgtcgggcggagatgattgacaggaaccgtatgctgcgggagacgttggaacgtgtgcgtgcggggtcgttctggttgtgggtggtggcggcgacgtttgcattttttaccggtttttcagtcacttatcttctaatggacaatcagggtctgaatttctttttggttttggcgggcgtgttgggcatgaatacgctgatgctggcagtatggttggcaatgttgttcctgcgtgtgaaagtggggcgttttttcagcagtccggcgacgtggtttcggggcaaagaccctgtaaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggccgtctgaacggcaatattgccgatgcgcgggcttggtcggggctgctggtcggcagtatcgcctgctacggcatcctgccgcgcctgctggcttgggtagtgtgtaaaatccttttgaaaacaagcgaaaacggattggatttggaaaagccctattatcaggcggtcatccgccgctggcagaacaaaatcaccgatgcggatacgcgtcgggaaaccgtgtccgccgtttcaccgaaaatcatcttgaacgatgcgccgaaatgggcggtcatgctggagaccgagtggcaggacggcgaatggttcgagggcaggctggcgcaggaatggctggataagggcgttgccaccaatcgggaacaggttgccgcgctggagacagagctgaagcagaaaccggcgcaactgcttatcggcgtgcgcgcccaaactgtgccggaccgcggcgtgttgcggcagattgtccgactctcggaagcggcgcagggcggcgcggtggtgcagcttttggcggaacaggggctttcagacgacctttcggaaaagctggaacattggcgtaacgcgctggccgaatgcggcgcggcgtggcttgagcctgacagggcggcgcaggaagggcgtttgaaagaccaataa

SEQ ID NO: 200 - protein, 446 aa, Neisseria meningitidis
MLNPSRKLVELVRILDEGGFIFSGDPVQATEALRRVDGSTEEKIIRRAEMIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 201 - DNA, 1350 bp, Neisseria meningitidis
  misc_feature (241)..(241): N= Unknown
  misc_feature (248)..(248): N= Unknown
  misc_feature (316)..(316): N= Unknown
  misc_feature (470)..(470): N= Unknown
  misc_feature (814)..(814): N= Unknown
  misc_feature (817)..(817): N= Unknown
  misc_feature (851)..(851): N= Unknown
  misc_feature (853)..(857): N= Unknown
  misc_feature (860)..(862): N= Unknown
  misc_feature (865)..(865): N= Unknown
  misc_feature (1206)..(1206): N= Unknown
atgttgaatccatcccgaaaactggttgagctggtccgtattttggaagaaggcggctttattttcagcggcgatcccgtgcaggcgacggaggctttgcgccgcgtggacggcagtacggaggaaaaaatcatccgtcgggcgaagatgatcgacaggaaccgtatgctgcgggagacgttggaacgtgtgcgtgcggggtcgttctggttgtgggtggcggcggcgacgtttgcgtttnttaccgntttttcagttacttatcttctaatggacaatcagggtctgaatttctttttggttttggcgggcgtgntgggcatgaatacgctgatgctggcagtatggttggcaatgttgttcctgcgcgtgaaagtggggcgttttttcagcagtccggcgacgtggtttcggggcaaagaccctgtcaatcaggcggtgttgcggctgtatgcggacgagtggcggcnaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgggcgattcgtcttcggtacggctggtggaaatgttggcatggctgcctgcgaaactgggttttcccgtgcctgatgcgcgggcggtcatcgaaggtcgtctgaacggcaatattgccgatgcgcgggcttggtcggggctgctggtcggcagtatcgcctgctacggcatcctgccgcgcctcttggcttgggcggtatgcaaaatccttntgnaaacaagcgaaaacggcttggatttggaaaagcncnnnnntcnnncgntcatccgccgctggcagaacaaaatcaccgatgcggatacgcgtcgggaaaccgtgtccgccgtttcgccgaaaatcgtcttgaacgatgcgccgaaatgggcggtcatgctggagaccgaatggcaggacggcgaatggttcgagggcaggctggcgcaggaatggctggataagggcgttgccgccaatcgggaacaggttgccgcgctggagacagagctgaagcagaaaccggcgcaactgcttatcggcgtgcgcgcccaaactgtgcccgaccgcggcgtgttgcggcagatcgtccgactttcggaagcggcgcagggcggcgcggtggtgcancttttggcggaacaggggctttcagacgacctttcggaaaagctggaacattggcgtaacgcgctgaccgaatgcggcgcggcgtggctggaacccgacagagcggcgcaggaaggccgtctgaaaaccaacgaccgcacttga

SEQ ID NO: 202 - protein, 449 aa, Neisseria meningitidis
  misc_feature (81)..(81): Xaa= any amino acid
  misc_feature (83)..(83): Xaa= any amino acid
  misc_feature (106)..(106): Xaa= any amino acid
  misc_feature (157)..(157): Xaa= any amino acid
  misc_feature (272)..(273): Xaa= any amino acid
  misc_feature (284)..(289): Xaa= any amino acid
  misc_feature (402)..(402): Xaa= any amino acid
MLNPSRKLVELVRILEEGGFIFSGDPVQATEALRRVDGSTEEKIIRRAKMIDRNRMLRETLERVRAGSFWLWVAAATFAFXTXFSVTYLLMDNQGLNFFLVLAGVXGMNTLMLAVWLAMLFLRVKVGRFFSSPATWFRGKDPVNQAVLRLYADEWRXPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILXXTSENGLDLEKXXXXXXIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVXLLAEQGLSDDLSEKLEHWRNALTECGAAWLEPDRAAQEGRLKTNDRT

SEQ ID NO: 203 - DNA, 8 bp, Neisseria gonorrhoeae
  misc_feature (1)..(8): N= Unknown
nnnnnnnn

SEQ ID NO: 204 - protein, 397 aa, Neisseria gonorrhoeae
MIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 205 - DNA, 1341 bp, Neisseria gonorrhoeae
atgttgaatccatcccgaaaactggttgagctggtccgtattttgaataaagggggttttattttcagcggcgatcctgtgcaggcgacggaggctttgcgccgcgtggacggcagtacggaggaaaaaatcttccgtcgggcggagatgatcgacagggaccgtatgttgcgggacacgttggaacgtgtgcgtgcggggtcgttctggttatgggtggtggtggcatcgatgatgtttaccgccggattttcaggcacttatcttctgatggacaatcaggggctgaatttctttttagttttggcgggagtgttgggcatgaatacgctgatgctggcagtatggttggcaacgttgttcctgcgcgtgaaagtgggacggtttttcagcagtccggcgacgtggtttcggggcaaaggccctgtaaatcaggcggtgttgcggctgtatgcggaccagtggcggcaaccttcggtacgatggaaaataggcgcaacggcgcacagcttgtggctctgcacgctgctcggaatgctggtgtcggtattgctgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggtcgtctgaacggcaatattgccgatgcgcgggcttggtcggggctgctggtcggcagtatcgtctgctacggcatcctgccgcgcctcttggcttgggtagtgtgtaaaatccttttgaaaacaagcgaaaacggattggatttggaaaaaacctattatcaggcggtcatccgccgctggcagaacaaaatcaccgatgcggatacgcgtcgggaaaccgtgtccgccgtttcgccgaaaatcgtcttgaacgatgcgccgaaatgggcgctcatgctggagaccgagtggcaggacggccaatggttcgagggcaggctggcgcaggaatggctggataagggcgttgccgccaatcgggaacaggttgccgcgctggagacagagctgaagcagaaaccggcgcaactgcttatcggcgtacgcgcccaaactgtgccggaccggggcgtgctgcggcagattgtgcggctttcggaagcggcgcagggcggcgcggtggtgcagcttttggcggaacaggggctttcagacgacctttcggaaaagctggaacattggcgtaacgcgctgaccgaatgcggcgcggcgtggcttgagcctgacagggtggcgcaggaaggccgtttgaaagaccaataa

SEQ ID NO: 206 - protein, 446 aa, Neisseria gonorrhoeae
MLNPSRKLVELVRILNKGGFIFSGDPVQATEALRRVDGSTEEKIFRRAEMIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 207 - DNA, 450 bp, Neisseria meningitidis
cagaagagtttgtcgagaatttctttatggggtttgggcggcgtgtttttcggggtgtccggtctggtatggttttctttgggcgtttctttgagtgcgcctgtttttcgggtgtttcttttcggggttcgggacgggggacgtttgtgggcagtacgggggtttctttgagtgtgttttcagcttgtgttccggcgtcgtccggctgcctgtcggtttgagctgtgtcggcaggttgcggtttgacccggtttttcttgggtgcggcaggggacgtcattctcctgccgctttcgtctgtgccgtccggctgtgcgggttcggatgaggcggcgtggtggtgttcgggttgggcggcatcttgttccgactacgccgtttggcagccagaattcggtttcgcgggggctgtcggtgtgttgcggttcggcttgaagggttttgtcgtcc

SEQ ID NO: 208 - protein, 150 aa, Neisseria meningitidis
  misc_feature (31)..(31): Xaa= any amino acid
  misc_feature (65)..(65): Xaa= any amino acid
  misc_feature (81)..(82): Xaa= any amino acid
QKSLSRISLWGLGGVFFGVSGLVWFSLGVSXECACFSGVSFRGSGRGTFVGSTGVSLSVFSACVXGVVRLPVGLSCVGRLXXLTRFFLGAAGDVILLPLSSVPSGCAGSDEAAWWCSGWAASCPTTPFGSQNSVSRGLSVCCGSARVLSS

SEQ ID NO: 209 - DNA, 1362 bp, Neisseria meningitidis
atgatgatgccgttcataatgcttccttggattgckggtgtgcctgccgtgccgggtcagaataggttgtccagaatttctttatggggtttgggcggcgtgtttttcggggtgtccggtttggtatggttttctttgggcgtttctttgggctgcgcctgtttttcgggtgtttcttttcggggttcgggacgggggacgtttgtgggcagtacgggggtttctttgagtgtgttttcagcttgtgttccggcgtcgtccggctgcctgtcggtttgagctgtgtcggcaggttgcggtttgacccggtttttcttgggtgcggcaggggacggcagtccgctgccgctttcgtctgtgccgtccggctgtgcgggttcggatgaggcggcgtggtggtgttcgggttgggcggcatcttgtccgactacgccgtttggcagccagaattcggtttcgcgggggctgtcggtgtgttgcggttcggcttgaagggttttgtcgccgttcgggttgaatgtgctgacgatgcctattgccaatgcgccgatggcggcgatacagatgagcaatacggcgcgtatcaggagtttgggggtcagcctgaagggtttgttcggtttttttgccattttgattgtgcttttggggtgtcgggcaatgccgtctgaaggcggttcagacggcattgccgagtcagcgttggacgtagttttggtagagggtgatgactttttgtacgccgacggtggtgctgactttttgggtaatctgcgcctgttcttcgggggtgaggatgcccataacgtaggttacgttgccgtaggtaacgattttgacgcgcgcctgtgtggcggggctgatgcccaacagcgtggcgcggactttggatgtgttccaagtgtcgccggcgatgtcgccggcagtgcgcggcagggaggcgacggtaatatagttgtacacgccttcggcggcctgttcggaacgtgcaatctgaccgacgaactgtttttcgccttcggtggcgacttgtccgagcagcagcaggtggcggttgtagccgacgacggagatttggggcgtgtagcctttggtttggttgttttggcgcagataggaacgggcggtggtttcgatacgcaacgccataacgttgtcgtcggtttgcgcgccggtggttcggcggtcgacggcggatttcgcgccgacggcggcgcttccgattactgcgctgacgcagccgctaagggcaaggctgaaaatggcggcaatcagggtgcggacggtgtgcggtttgggtttcatcgggtgcttcctttcttgggcgtttcagacggcattgctttgcgccatgccgtctga

SEQ ID NO: 210 - protein, 451 aa, Neisseria meningitidis
MMMPFIMLPWIAGVPAVPGQNRLSRISLWGLGGVFFGVSGLVWFSLGVSLGCACFSGVSFRGSGRGTFVGSTGVSLSVFSACVPASSGCLSVAVSAGCGLTRFFLGAAGDGSPLPLSSVPSGCAGSDEAAWWCSGWAASCPTTPFGSQNSVSRGLSVCCGSARVLSPFGLNVLTMPIANAPMAAIQMSNTARIRSLGVSLKGLFGFFAILIVLLGCRAMPSEGGSDGIAESALDVVLVEGDDFLYADGGADFLGNLRLFFGGEDAHNVGYVAVGNDFDARLCGGADAQQRGADFGCVPSVAGDVAGSARQGGDGNIVVHAFGGLFGTCNLTDELFFAFGGDLSEQQQVAVVADDGDLGRVAFGLVVLAQIGTGGGFDTQRHNVVVGLRAGGSAVDGGFRADGGASDYCADAAAKGKAENGGNQGADGVRFGFHRVLPFLGVSDGIALRHAV

SEQ ID NO: 211 - DNA, 1380 bp, Neisseria meningitidis
  misc_feature (9)..(9): N= Unknown
  misc_feature (15)..(15): N= Unknown
  misc_feature (77)..(77): N= Unknown
  misc_feature (100)..(100): N= Unknown
  misc_feature (148)..(148): N= Unknown
  misc_feature (166)..(166): N= Unknown
  misc_feature (234)..(234): N= Unknown
  misc_feature (296)..(296): N= Unknown
  misc_feature (328)..(328): N= Unknown
  misc_feature (336)..(336): N= Unknown
  misc_feature (413)..(413): N= Unknown
  misc_feature (416)..(416): N= Unknown
  misc_feature (507)..(507): N= Unknown
  misc_feature (522)..(522): N= Unknown
  misc_feature (533)..(533): N= Unknown
  misc_feature (637)..(637): N= Unknown
  misc_feature (734)..(734): N= Unknown
  misc_feature (973)..(973): N= Unknown
  misc_feature (1105)..(1105): N= Unknown
  misc_feature (1184)..(1184): N= Unknown
atgatgatnccgttnataatgcttccttggattgcgggtgtgcctgccgtgccgggtcagaagaggttgtcgagaanttctttatggggtttaggcggcntgtttttcggggtgtccggtttggtatggttttctttgggcgtttctntttctttgggtgtttctntgggctgtgcctgtttttcgggtgtttcttttcggggttcgggacgggggacgtttgtgggcagtacnggggtttctttgagtgtgttttcagcttgtgctccggcgtcgtccggctgcctgtcggtttnagctgtgtcggcaggttgcggtttgacccggnttttcttnggtgcggcaggggacggcagtccgctgccgctttcgtctgtgccgtccggctgtgcgggtgcggatgaggaggcgtngtngtgttcgggttgggcggcatcttgtccgactacgccgtttggcagccagaattcggtttcgcgggggctgtcggtgtgttgcggttcggtntggagggttttgtcnccgttcgggtngaatgtgctgacgatgcctattgccaatgcgccgatggcggtgatacagatgagcaatacggcgcgtatcaggagtttgggggtcagcctgaagggtttgttcngtttttttgccattttgattgtgcttttggggtgtcgggcaatgccgtctgaaggcggttcagacggcattgccgagtcagcgttggacgtagtttnggtagagggtgatgactttttgtacgccgacggtggtgctgactttttgggtaatctgcgcctgttcttcgggggtgaggatgcccataacgtaggttacgttgccgtaggtaacgattttgacgcgcgcctgtgtggcggggctgatgcccaacagcgtggcgcggactttggatgtgttccaagtgtcgccggcgatgtcgccggcagtgcgcggcagggaggcgacggtaatgtanttgtacacgccttcggcggcctgttcggaacgtgcaatctgaccgacgaactgtttctcgccttcggtggcgacttgtccgagcagcagcaggtggcggttgtagccgacaacggagatttggggcgtgtancctttggtttggttgttttggcgcagataggagcgggcggtggtttcgatacgcagcgccattacgttgtcgtcggttngcgcgccggtggttcggcggtcgacggcggatttcgcgccgaccgccgcgccgccgacgactgcgctgacgcagccgccgagggcaaggctgaggacggcggcagtcagggtgcggacggtgtgcggtttgggtttcatcgggtgcttcctttcttgggcgtttcagacggcattgctttgcgccatgccgtctga

SEQ ID NO: 212 - protein, 459 aa, Neisseria meningitidis
  misc_feature (3)..(3): Xaa= any amino acid
  misc_feature (5)..(5): Xaa= any amino acid
  misc_feature (26)..(26): Xaa= any amino acid
  misc_feature (34)..(34): Xaa= any amino acid
  misc_feature (50)..(50): Xaa= any amino acid
  misc_feature (56)..(56): Xaa= any amino acid
  misc_feature (99)..(99): Xaa= any amino acid
  misc_feature (110)..(110): Xaa= any amino acid
  misc_feature (112)..(112): Xaa= any amino acid
  misc_feature (138)..(139): Xaa= any amino acid
  misc_feature (178)..(178): Xaa= any amino acid
  misc_feature (213)..(213): Xaa= any amino acid
  misc_feature (245)..(245): Xaa= any amino acid
  misc_feature (325)..(325): Xaa= any amino acid
  misc_feature (369)..(369): Xaa= any amino acid
  misc_feature (395)..(395): Xaa= any amino acid
MMXPXIMLPWIAGVPAVPGQKRLSRXSLWGLGGXFFGVSGLVWFSLGVSXSLGVSXGCACFSGVSFRGSGRGTFVGSTGVSLSVFSACAPASSGCLSVXAVSAGCGLTRXFXGAAGDGSPLPLSSVPSGCAGADEEAXXCSGWAASCPTTPFGSQNSVSRGLSVCCGSVWRVLSPFGXNVLTMPIANAPMAVIQMSNTARIRSLGVSLKGLFXFFAILIVLLGCRAMPSEGGSDGIAESALDVVXVEGDDFLYADGGADFLGNLRLFFGGEDAHNVGYVAVGNDFDARLCGGADAQQRGADFGCVPSVAGDVAGSARQGGDGNVXVHAFGGLFGTCNLTDELFLAFGGDLSEQQQVAVVADNGDLGRVXFGLVVLAQIGAGGGFDTQRHYVVVGXRAGGSAVDGGFRADRRAADDCADAAAEGKAEDGGSQGADGVRFGFHRVLPFLGVSDGIALRHAV

SEQ ID NO: 213 - DNA, 1380 bp, Neisseria gonorrhoeae
atgatgatgccgttcataatgcttccttggattgcgggtgtgcctgccgtgccgggtcaaaagaggttgtcgagaatctctttatggggtttggccggcgtgtttttcggggtgtccggtttggtatggttttctttgggcgtttctttttctttgggtgtttctttgggctgcgcctgtttttcgggtgtttcttttcggggttcgggatggggggcgtttgtgggcagtacgggggtttctttgagtgtgttttcagcttgtgttccggtgccggttaacgaatcggctgcccgggccgcatccgaagggcgcggtttgacccggtttttcttgggtgcggcaggggacggcagtccgctgccgctttcttctgtgccgtccggctgtgcgggttcggatgaggcggcgtggtggtgttcgggttgggcggcatcttgtccgacggcgccgtttggcagccagaattcggtttcgcgggggctgtcggtgtgttgcggttcggtttggagggttttgtcgccgttcgggttgaatgtgctgacgatgcctactgccaatgcgccgatggcggtgatacagatgagcaatacggcgcgtatcaggagtttgggggtcagcctgaagggtttgttcggtttttttgccattttgattgtgcttttggggtgtcgggcaatgccgtctgaaggcggttcagacggcattgccgagtcagcgttggacgtagttttggtagagggtaatgactttttgtacgccgacggtggtgctgactttttgggtaatctgcgcctgttcttcgggggtgaggatgcccataacgtaggttacattgccgtaggtaatgattttgacgcgcgcctgtgtagcggggctgatgcccagcagcgtggcgcggactttggacgtgttccaagtgtcgccggcgatgtcgcccgcagtgcgcggcagggaggcgacggtaatgtagttgtatacgccttcggcggcctgttcggaacgtgcaatctgaccgacgaactgtttttcgccttcggtggcgacttgtccgagcagcagcaggtggcggttgtagccgacgacggagatttggggcgtgtagcctttggtttggttgttttggcgcaggtaggaacgggcggtggtttcgatacgcaacgccataacgttgtcatcggtttgcgcgccggtggttcggcggtcgatgacggattttgcgccgacggcggccccgccgacgactgcgctgaagcagccgccgagggcaaggctgaggacggcggcaatcagggtgcggacggtgtgtggtttgggtttcatcggggacttcctttcttgggcgtttcagacggcattgctttgcgccatgccgtctga

SEQ ID NO: 214 - protein, 459 aa, Neisseria gonorrhoeae
MMMPFIMLPWIAGVPAVPGQKRLSRISLWGLAGVFFGVSGLVWFSLGVSFSLGVSLGCACFSGVSFRGSGWGAFVGSTGVSLSVFSACVPVPVNESAARAASEGRGLTRFFLGAAGDGSPLPLSSVPSGCAGSDEAAWWCSGWAASCPTAPFGSQNSVSRGLSVCCGSVWRVLSPFGLNVLTMPTANAPMAVIQMSNTARIRSLGVSLKGLFGFFAILIVLLGCRAMPSEGGSDGIAESALDVVLVEGNDFLYADGGADFLGNLRLFFGGEDAHNVGYIAVGNDFDARLCSGADAQQRGADFGRVPSVAGDVARSARQGGDGNVVVYAFGGLFGTCNLTDELFFAFGGDLSEQQQVAVVADDGDLGRVAFGLVVLAQVGTGGGFDTQRHNVVIGLRAGGSAVDDGFCADGGPADDCAEAAAEGKAEDGGNQGADGVWFGFHRGLPFLGVSDGIALRHAV

SEQ ID NO: 215 - DNA, 279 bp, Neisseria meningitidis
atgaaaaccttcttcaaaaccctttccgccgccgcactcgcgctcatcctcgccgcctgcggattcaaaaagacagcgcgcccgccgcatccgcttctgccgccgccgacaacggcgcggcgtaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttg

SEQ ID NO: 216 - protein, 92 aa, Neisseria meningitidis
MKTFFKTLSAAALALILAACGQKDSAPAASASAAADNGAAKKEIVFGTTVGDFGDMVKEQIQAELEKKGYTVKLVEFTDYVRPNLALAEGEL

SEQ ID NO: 217 - DNA, 864 bp, Neisseria meningitidis
atgaaaaccttcttcaaaaccctttccgccgccgcactcgcgctcatcctcgccgcctgcggcggtcaaaaagacagcgcgcccgccgcatccgcttctgccgccgccgacaacggcgcggcgaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgttgaccgcatccaaagcggacatcgccgagaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 218 - protein, 287 aa, Neisseria meningitidis
MKTFFKTLSAAALALILAACGGQKDSAPAASASAAADNGAAKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 219 - DNA, 864 bp, Neisseria meningitidis
  misc_feature (126)..(126): N= Unknown
  misc_feature (183)..(183): N= Unknown
  misc_feature (233)..(233): N= Unknown
  misc_feature (250)..(250): N= Unknown
  misc_feature (294)..(294): N= Unknown
  misc_feature (302)..(302): N= Unknown
  misc_feature (305)..(305): N= Unknown
  misc_feature (320)..(320): N= Unknown
  misc_feature (328)..(328): N= Unknown
  misc_feature (349)..(350): N= Unknown
  misc_feature (357)..(357): N= Unknown
  misc_feature (411)..(412): N= Unknown
  misc_feature (423)..(423): N= Unknown
  misc_feature (455)..(457): N= Unknown
  misc_feature (464)..(464): N= Unknown
  misc_feature (497)..(497): N= Unknown
  misc_feature (514)..(514): N= Unknown
  misc_feature (521)..(533): N= Unknown
  misc_feature (535)..(535): N= Unknown
  misc_feature (537)..(537): N= Unknown
  misc_feature (539)..(539): N= Unknown
  misc_feature (541)..(543): N= Unknown
  misc_feature (546)..(546): N= Unknown
  misc_feature (548)..(554): N= Unknown
  misc_feature (556)..(559): N= Unknown
  misc_feature (561)..(575): N= Unknown
  misc_feature (577)..(578): N= Unknown
  misc_feature (581)..(587): N= Unknown
  misc_feature (589)..(601): N= Unknown
  misc_feature (604)..(605): N= Unknown
  misc_feature (607)..(612): N= Unknown
  misc_feature (615)..(619): N= Unknown
  misc_feature (621)..(622): N= Unknown
  misc_feature (624)..(626): N= Unknown
  misc_feature (628)..(632): N= Unknown
  misc_feature (634)..(635): N= Unknown
  misc_feature (637)..(645): N= Unknown
  misc_feature (647)..(651): N= Unknown
  misc_feature (653)..(654): N= Unknown
  misc_feature (656)..(657): N= Unknown
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaanaaagaaatcgtcttcggcacgaccgtcggcgacttcggcgatatggtcaaagaacanatccaacccgagctggagaaaaaaggctacaccgtcaaactggtcgagtntaccgactatgtgcgcncgaatctggcattggctgagggcgagttggacatcaacgtcttncaacacanacnctatcttgacgactncaaaaaanaacacaatctggacatcaccnnagtcttncaagtgccgaccgcgcctttgggactgtacccgggcaagctgaaatcgctggannaagtcaaaganggcagcaccgtatccgcgcccaacgacccgtnnnacttcgnccgcgtcttggtgatgctcgacgaactgggttngatcaaactcaaagacngcatcannnngnngnnnnnancnanannnganannnnnnnannnntnnnnnnnnnnnnnnncnncgnnnnnnnannnnnnnnnnnnncgnntnnnnnngcnnnnntnnannntnnnnncnncnnnnnnnnntnnnnnannannagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 220 - protein, 287 aa, Neisseria meningitidis
  misc_feature (42)..(42): Xaa= any amino acid
  misc_feature (61)..(61): Xaa= any amino acid
  misc_feature (78)..(78): Xaa= any amino acid
  misc_feature (84)..(84): Xaa= any amino acid
  misc_feature (98)..(98): Xaa= any amino acid
  misc_feature (101)..(102): Xaa= any amino acid
  misc_feature (107)..(107): Xaa= any amino acid
  misc_feature (110)..(110): Xaa= any amino acid
  misc_feature (117)..(117): Xaa= any amino acid
  misc_feature (119)..(119): Xaa= any amino acid
  misc_feature (137)..(138): Xaa= any amino acid
  misc_feature (141)..(141): Xaa= any amino acid
  misc_feature (152)..(153): Xaa= any amino acid
  misc_feature (155)..(155): Xaa= any amino acid
  misc_feature (166)..(166): Xaa= any amino acid
  misc_feature (172)..(172): Xaa= any amino acid
  misc_feature (174)..(204): Xaa= any amino acid
  misc_feature (206)..(219): Xaa= any amino acid
MKTFFKTLSAAALALILAACGGQKDSAPAASASAAADNGAAXKEIVFGTTVGDFGDMVKEXIQPELEKKGYTVKLVEXTDYVRXNLALAEGELDINVXQHXXYLDDXKKXHNLDITXVXQVPTAPLGLYPGKLKSLXXVKXGSTVSAPNDPXXFXRVLVMLDELGXIKLKDXIXXXXXXXXXXXXXXXXXXXXXXXXXXXXXXXAXXXXXXXXXXXXXXSGMKLTEALFQEPSFAYVNWSAVKTADKDSQWLKDVTEAYNSDAFKAYAHKRFEGYKSPAAWNEGAAK

SEQ ID NO: 221 - DNA, 864 bp, Neisseria meningitidis
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaaaaaagaaatcgtcttcggcacgaccgtcggcgacttcggcgatatggtcaaagaacaaatccaacccgagctggagaaaaaaggctacaccgtcaaactggtcgagtttaccgactatgtgcgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgctgaccgcatccaaagcggacattgccgaaaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 222 - protein, 287 aa, Neisseria meningitidis
MKTFFKTLSAAALALILAACGGQKDSAPAASASAAADNGAAKKEIVFGTTVGDFGDMVKEQIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 223 - DNA, 8 bp, Neisseria gonorrhoeae
  misc_feature (1)..(8): N= Unknown
nnnnnnnn

SEQ ID NO: 224 - protein, 288 aa, Neisseria gonorrhoeae
MKTFFKTLSTASLALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 225 - DNA, 867 bp, Neisseria gonorrhoeae
atgaaaaccttcttcaaaaccctttccgccgccgcactcgcgctcatcctcgcagcctgcggcggtcaaaaagacagcgcgcccgcagcctctgccgccgccccttctgccgataacggcgcggcgaaaaaagaaatcgtcttcggcacgaccgtgggcgacttcggcgatatggtcaaagaacaaatccaagccgagctggagaaaaaaggctacaccgtcaaattggtcgaatttaccgactatgtgcgcccgaatctggcattggcggagggcgagttggacatcaacgtcttccaacacaaaccctatcttgacgatttcaaaaaagaacacaacctggacatcaccgaagccttccaagtgccgaccgcgcctttgggactgtatccgggcaaactgaaatcgctggaagaagtcaaagacggcagcaccgtatccgcgcccaacgacccgtccaacttcgcacgcgccttggtgatgctgaacgaactgggttggatcaaactcaaagacggcatcaatccgctgaccgcatccaaagccgacatcgcggaaaacctgaaaaacatcaaaatcgtcgagcttgaagccgcacaactgccgcgcagccgcgccgacgtggattttgccgtcgtcaacggcaactacgccataagcagcggcatgaagctgaccgaagccctgttccaagagccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaataccctgccgcatggaatgaaggcgcagccaaataa

SEQ ID NO: 226 - protein, 288 aa, Neisseria gonorrhoeae
MKTFFKTLSAAALALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 227 - DNA, 907 bp, Neisseria meningitidis
cctcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctmtgctggcagggctgacgatgtgtatgctcatcggcgacaacggcagcgaatggctcgacagcggactcatgcgcgccatgaacgtcctcatcggcgyggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagctgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaacgcagacacgcccgccgcatccgcatcgacaccgccatcaaccccgaactggaagccctcgccgaacacctccactaccaatggcagggcttcctctggctcagcaccgatatgcgtcaggaaatttccgccctcgtcatcctgctgcaacgcacccgccgcaaatggctggatgcccacgaacgccaacacctgcgccaaagcctgcttga

SEQ ID NO: 228 - protein, 301 aa, Neisseria meningitidis
  misc_feature (72)..(72): Xaa= any amino acid
  misc_feature (195)..(195): Xaa= any amino acid
  misc_feature (224)..(224): Xaa= any amino acid
PRRPRHAPVSRGDLLQGGGTYARHGHRAGRGFGRFMAEPALFPRQPPLLPHRRHGKRTGRLGGGRQKRLRPXAGRADDVYAHRRQRQRMARQRTHARHERPHRRGHRHRRRQTAAAEIHTDVAFHACRQPGRLQQNDCRNQQRQAHDPRTPRGEHGENAPNQRTHGQKPQPSRRHIGRKLHQPRHDGSHAARPPXNRQHHRAAPDHRRQAAISQTQRQRNPAAXPPLHTAPNQTRPPHPHRHRHQPRTGSPRRTPPLPMAGLPLAQHRYASGNFRPRHPAATHPPQMAGCPRTPTPAPKPA

SEQ ID NO: 229 - DNA, 8 bp, Neisseria gonorrhoeae
  misc_feature (1)..(8): N= Unknown
nnnnnnnn

SEQ ID NO: 230 - protein, 318 aa, Neisseria gonorrhoeae
MDRDDRLRRPRHAPVPRRDLLQRGGTYARYGHRAGRGFGRFMAEPALFPRQPPLLPDHRHGKRTGRLGGGRQKRLRPYVGGADDVHAHRRQRQRMARQRPDARDERPHRRRHRHCRRQTAAAEIHTDVAFHACRQPGRLQQNDCRNQQRQAYDARTFGAEYGQNAPNQRTHGQKPQPPRRHIGRKPHQPLHDGSHAARPPQNRQHHRAAPDHRRQAAISQTQRQRNPAARPPLHTAPNRPATNRRPHQRQTRPPHPHRHRHQPRTGSPRRTPPLPMAGFPLAQHQYASGNFRPRHPPATHPPQMAGCPRTPTPAPKPA

SEQ ID NO: 231 - DNA, 567 bp, Neisseria meningitidis
  misc_feature (22)..(22): N= Unknown
  misc_feature (40)..(40): N= Unknown
gaaatcagcctgcggtccgacnacaggccggtttccgtgncgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcggagaggaaccatcatgcccggtttccacctgatgaaagaatcgctcgccgtccgaaccgccaacctcaaccggcacgccggtaagcgttatcctttcccgaccgg

SEQ ID NO: 232 - protein, 189 aa, Neisseria meningitidis
  misc_feature (8)..(8): Xaa= any amino acid
  misc_feature (14)..(14): Xaa= any amino acid
  misc_feature (102)..(102): Xaa= any amino acid
  misc_feature (156)..(156): Xaa= any amino acid
EISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQAXGIRNHYRHPEEHGSDRWFNALGSRRFSRNACVVVSCGTAVTVDALTDDGHYLGXGTIMPGFHLMKESLAVRTANLNRHAGKRYPFPT

SEQ ID NO: 233 - DNA, 1779 bp, Neisseria meningitidis
atgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaa

SEQ ID NO: 234 - protein, 592 aa, Neisseria meningitidis
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 235 - DNA, 1779 bp, Neisseria meningitidis
atgacggttttgaagccttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgtgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 236 - protein, 592 aa, Neisseria meningitidis
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 237 - DNA, 8 bp, Neisseria gonorrhoeae
  misc_feature (1)..(8): N= Unknown
nnnnnnnn

SEQ ID NO: 238 - protein, 455 aa, Neisseria gonorrhoeae
MFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 239 - DNA, 1779 bp, Neisseria gonorrhoeae
atgacggttttgaagccttcgcattggcgggtgttggcggagcttgccgacggtttgccgcaacacgtatcgcaattggcgcgtgaggcggacatgaagccgcagcagctcaacggtttttggcagcagatgccggcgcatatacgcgggctgttgcgccaacacgacggctattggcggctggtgcgccccttggcggttttcgatgccgaaggtttgcgcgatctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgcctgatgttcagtttcggctgggcgtttgaccggccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 240 - protein, 592 aa, Neisseria gonorrhoeae
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 241 - DNA, 648 bp, Neisseria meningitidis
atgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgc

SEQ ID NO: 242 - protein, 216 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGC

SEQ ID NO: 243 - DNA, 855 bp, Neisseria meningitidis
atgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgcggctggtacgcctattggctgtggaacaaggggatgagccgtgttcctgccaatgtttcgggactgttgatttcgctcgaacccgtcgtcggcgtgctgctggcggttttgattttgggcgaacacctgtcgcccgtgtccgccttgggcgtgtttgtcgtcatcgccgccaccttggttgccggccggctgtcgcatcaaaaataa

SEQ ID NO: 244 - protein, 284 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANVSGLLISLEPVVGVLLAVLILGEHLSPVSALGVFVVIAATLVAGRLSHQK

SEQ ID NO: 245 - DNA, 855 bp, Neisseria meningitidis
atgttttaccaaatccttgccctgattatctggagcagctcgtttattgccgccaaatatgtctatggcggcatcgatcccgcattgatggtcggcgtgcgcctgctgattgctgcgctgcctgcactgcccgcctgccgccgtcatgtcggcaagattccgcgtgaggaatggaagccgttgctgattgtgtcgttcgtcaactatgtgctgaccctgctacttcagtttgtcgggttgaaatacacttccgccgccagcgcatcggtcattgtcggactcgagccactgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcggaatggtattgtcgctgctgtatttgggcgtggggtgcagctggtacgcctattggctgtggaacaaggggatgagccgtgttcctgccaacgtttcgggactgttgatttcgctcgaacccgtcgtcggcgtgctgctggcggttttgattttgggcgaacacctgtcgcccgtgtccgtcttgggcgtgtttgtcgtcatcgccgccaccttggttgccggccggctgtcgcatcaaaaataa

SEQ ID NO: 246 - protein, 284 aa, Neisseria meningitidis
MFYQILALIIWSSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGVGCSWYAYWLWNKGMSRVPANVSGLLISLEPVVGVLLAVLILGEHLSPVSVLGVFVVIAATLVAGRLSHQK

SEQ ID NO: 247 - DNA, 876 bp, Neisseria gonorrhoeae
atgttttaccaaatccttgccctgattatctggggcagctcgtttattgccgccaaatatgtctatggcggcatcgatcccgcattgatggtcggcgtgcgcctgctgattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcccgcatcggcgcaccggcattcacatctgtttccattgccgccgcatcgttgatgtgcctgccgttttcgcttgctttggcgcaaagttataccgtggactggagcgtcgggatggtattgtcgctgttgtatttgggtttggggtgcggctggtacgcctattggctgtggaacaaggggatgagccgtgttcctgccaacgcgtcgggactgttgatttcgctcgaacccgtcgtcggcgtgctgttggcggttttgattttgggcgaacatttatcgcccgtgtccgccttgggcgtgtttgtcgtcatcgccgccactttcgccgccggccggctgtcgcgcagggacgcgcaaaacggcaatgccgtctga

SEQ ID NO: 248 - protein, 291 aa, Neisseria gonorrhoeae
MFYQILALIIWGSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANASGLLISLEPVVGVLLAVLILGEHLSPVSALGVFVVIAATFAAGRLSRRDAQNGNAV

SEQ ID NO: 249 - DNA, 1182 bp, Neisseria meningitidis
atgcgccgttttctaccgatcgcagccatatgcgcmgwmstcctgkkgtasggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgctasrtygccaaagsgcctgkkstgggatgtttacgctggttgccgkactgcccggcgtgtttctgttcggctttcccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaaykscgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacwacgggcgcgattacgccttgtttttccgtcagccggttcccaaaggcgtggcagaggatgccgtyttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccargttgttcaaccacatgaccgagcagctttccatcgccaaagatgcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcgggtacc

SEQ ID NO: 250 - protein, 394 aa, Neisseria meningitidis
  misc_feature (13)..(14): Xaa= any amino acid
  misc_feature (16)..(17): Xaa= any amino acid
  misc_feature (70)..(71): Xaa= any amino acid
  misc_feature (74)..(74): Xaa= any amino acid
  misc_feature (76)..(78): Xaa= any amino acid
  misc_feature (85)..(85): Xaa= any amino acid
  misc_feature (174)..(174): Xaa= any amino acid
  misc_feature (229)..(229): Xaa= any amino acid
  misc_feature (335)..(335): Xaa= any amino acid
MRRFLPIAAICAXXLXXGLTAATGSTSSLADYFWWIVAFSAMLLLVLSAVLARYVILLLKDRRDGVFGSXXAKXPXXXMFTLVAXLPGVFLFGFPAQFINGTINSWFGNDTHEALERSLNLSKSALNLAADNALGNAVPVQIDLIGAASLPGDMGRVLEHYAGSGFAQLALYNXASGKIEKSINPHKLDQPFPGKARWEKIQRAGSVRDLESIGGVLYAQGWLSAGTHXGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTXLFNHMTEQLSIAKDADERNRRREEAARHYLECVLEGLTTGVVVFDEQGCLKTFNKAAGT

SEQ ID NO: 251 - DNA, 2121 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggctggcgtggaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggagcttgccggcgaaccgctgacggtggcggcggatacgaccgccatgcggcaggtgctgcacaatattttcaaaaatgccgccgaagcggcggaagaagccgatgtgcccgaagtcagggtaaaatcggaaacagggcaggacggtcggattgtcctgacggtttgcgacaacggcaaagggttcggcagggaaatgctgcacaacgccttcgagccgtatgtaacggacaaaccggcgggaacgggattgggtctgcctgtggtgaaaaaaatcattgaagaacacggcggccgcatcagcctgagcaatcaggatgcgggtggcgcgtgtgtcagaatcatcttgccaaaaacggtaaaaacttatgcgtag

SEQ ID NO: 252 - protein, 706 aa, Neisseria meningitidis
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIVKQVAALKEMVEAFRNYARSPSLKLENQDLNALIGDVLALYEAGPCRFAAELAGEPLTVAADTTAMRQVLHNIFKNAAEAAEEADVPEVRVKSETGQDGRIVLTVCDNGKGFGREMLHNAFEPYVTDKPAGTGLGLPVVKKIIEEHGGRISLSNQDAGGACVRIILPKTVKTYA

SEQ ID NO: 253 - DNA, 2121 bp, Neisseria meningitidis
  misc_feature (427)..(427): N= Unknown
  misc_feature (451)..(451): N= Unknown
  misc_feature (625)..(626): N= Unknown
  misc_feature (657)..(657): N= Unknown
  misc_feature (674)..(675): N= Unknown
  misc_feature (769)..(769): N= Unknown
  misc_feature (772)..(772): N= Unknown
  misc_feature (774)..(776): N= Unknown
  misc_feature (778)..(778): N= Unknown
  misc_feature (819)..(819): N= Unknown
  misc_feature (840)..(840): N= Unknown
  misc_feature (1384)..(1384): N= Unknown
  misc_feature (1560)..(1560): N= Unknown
  misc_feature (1648)..(1648): N= Unknown
  misc_feature (1663)..(1663): N= Unknown
  misc_feature (1999)..(1999): N= Unknown
  misc_feature (2042)..(2042): N= Unknown
  misc_feature (2078)..(2078): N= Unknown
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttccgggatgtttacgctggttgccgtactgcccggcgtgtttctgttcggcgtttccgcacagtttatcaacggcacgattaattcgtggttcggcaacgatacccacgaggcgcttgaacgcagcctcaatttgagcaagtccgcattgaatctggcggcagacaacgcccttggcaacgccatccccgtgcagatagacntcatcggcgcggcttccctgcccngggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacaggcgggttcggtcagggatnnggaaagcataggcggcgtattgtacgcgcanggctggctgtcggcagnnacgcacaacgggcgcgattacgccttgtttttccgtcagccggttcccaaaggcgtggcagaggatgccgtcttaatcgaaaaggcaagggcgnaanannntnagttgagttacagcaaaaaaggtttgcagacctttttcctngcaaccctgctgattgcctcnctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccagacattatctcgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacngcaacggcgtggtaatggtgattgacgacatcaccgttttgatacacgcgcaaaaagaagccgcgtggggcgaagtggcaaaacggctggcacacgaaatccgcaatccgctcacgcccatccagctttctgccgaacggctggcgtggaaattgggcgggaagctggacgagcangacgcgcaaatcctgacacgttcgaccgacaccatcatcaaacaagtggcggcattaaaagaaatggtcgaggcattccgcaattacncgcgttccccttcgnctcaattggaaaatcaggatttgaacgccttaatcggcgatgtgttggcattgtacgaagctggtccgtgccggtttgcggcggaacttgccggcgaaccgctgatgatggcggcggatacgaccgccatgcggcaggtgctgcacaatattttcaaaaatgccgccgaagcggcggaagaagccgatgtgcccgaagtcagggtaaaatcggaagcggggcaggacggacggattgtcctgacagtttgcgacaacggcaaggggttcggcagggaaatgctgcacaatgccttcgagccgtatgtaacggacaaaccggctggaacgggattgngactgcccgtggtgaaaaaaatcattgaagaacacggcggccncatcagcctgagcaatcaggatgcgggcggcgcgtntgtcagaatcatcttgccaaaaacggtagaaacttatgcgtag

SEQ ID NO: 254 - protein, 706 aa, Neisseria meningitidis
  misc_feature (143)..(143): Xaa= any amino acid
  misc_feature (151)..(151): Xaa= any amino acid
  misc_feature (209)..(209): Xaa= any amino acid
  misc_feature (219)..(219): Xaa= any amino acid
  misc_feature (225)..(225): Xaa= any amino acid
  misc_feature (257)..(260): Xaa= any amino acid
  misc_feature (462)..(462): Xaa= any amino acid
  misc_feature (520)..(520): Xaa= any amino acid
  misc_feature (550)..(550): Xaa= any amino acid
  misc_feature (555)..(555): Xaa= any amino acid
  misc_feature (667)..(667): Xaa= any amino acid
  misc_feature (681)..(681): Xaa= any amino acid
  misc_feature (693)..(693): Xaa= any amino acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDXIGAASLPXDMGRVLEHYAGSGFAQLALYNAASGKIEKSINPHKLDQPFPGKARWEKIQQAGSVRDXESIGGVLYAXGWLSAXTHNGRDYALFFRQPVPKGVAEDAVLIEKARAXXXXLSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNXNGVVMVIDDITVLIHAQKEAAWGEVAKRLAHEIRNPLTPIQLSAERLAWKLGGKLDEXDAQILTRSTDTIIKQVAALKEMVEAFRNYXRSPSXQLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLXLPVVKKIIEEHGGXISLSNQDAGGAXVRIILPKTVETYA

SEQ ID NO: 255 - DNA, 8 bp, Neisseria gonorrhoeae
  misc_feature (1)..(8): N= Unknown
nnnnnnnn

SEQ ID NO: 256 - protein, 400 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVSYPLSCCRTAVFSTCHSSPLSYF

SEQ ID NO: 257 - DNA, 2121 bp, Neisseria gonorrhoeae
atgcgccgcttcctaccgatcgcagccatatgcgccgtcgtcctgctgtacggattgacggcggcgaccggcagcaccagttcgctggcggattatttctggtggatagtctcgttcagcgcaatgctgctgctggtgttgtccgccgttttggcacgttatgtcatattgctgttgaaagacaggcgcaacggcgtgttcggttcgcagattgccaaacgcctttccgggatgttcacgctggtcgccgtactgcccggcttgttcctgttcggcatttccgcgcagtttatcaacggcacgattaattcgtggttcggcaacgacacccacgaagccctcgaacgcagccttaatttgagcaagtccgcactggatttggcggcagacaatgccgtcagcaacgccgttcccgtacagatagacctcatcggcaccgcctccctgtcgggcaatatgggcagtgtgctggaacactacgccggcagcggttttgcccagcttgccctgtacaatgccgcaagcgggaaaatcgaaaaaagcatcaatccgcaccaattcgaccagccgcttcccgacaaagaacattgggaacagattcagcagaccggttcggttcggagtttggaaagcataggcggcgtattgtacgcgcagggatggttgtcggcaggtacgcacaacgggcgcgattacgcgctgttcttccgccagccgattcccgaaaatgtggcacaggatgccgttctgattgaaaaggcgcgggcgaaatatgccgaattgagttacagcaaaaaaggtttgcagaccttttttctggtaaccctgctgattgcctcgctgctgtcgatttttcttgcgctggtaatggcactgtattttgcccgccgtttcgtcgaacccattctgtcgcttgccgagggcgcaaaggcggtggcgcagggtgatttcagccagacgcgccccgtattgcgcaacgacgagttcggacgtttgaccaagctgttcaaccatatgaccgagcagctttccatcgccaaagaagcagacgaacgcaaccgccggcgcgaggaagccgcccgtcactacctcgagtgcgtgttggatgggttgactaccggtgtggtggtgtttgacgaaaaaggccgtttgaaaaccttcaacaaggcggcggaacagattttggggatgccgctcgcccccctgtggggcagcagccggcacggttggcacggcgtttcggcgcagcagtccctgcttgccgaagtgtttgccgccatcggtgcggcggcaggtacggacaaaccggtccaggtggaatatgccgcgccggacgatgccaaaatcctgctgggcaaggcgacggtattgcccgaagacaacggcaacggcgtggtgatggtgattgacgacatcaccgtgctgatacgcgcgcaaaaagaagccgcgtggggtgaagtggcgaagcggctggcacacgaaatccgcaatccgctcacgcccatccagctttccgccgaacggctggcgtggaaattgggcgggaagctggacgatcaggacgcgcaaatcctgacgcgttcgaccgacaccatcatcaaacaggtggcggcgttaaaagaaatggtcgaggcattccgcaattacgcgcgcgccccttcgctcaaactggaaaatcaggatttgaacgccttaatcggcgatgttttggccctgtacgaagccggcccgtgccggtttgaggcggaacttgccggcgaaccgctgatgatggcggcggatacgaccgccatgcggcaggtgctgcacaatattttcaaaaatgccgccgaagcggcggaagaagccgatatgcccgaagtcagggtaaaatcggaaacggggcaggacggacggattgtcctgacggtttgcgacaacggcaagggattcggcaaggaaatgctgcacaatgctttcgagccgtatgtgacggataagccggcgggaacgggactgggtctgcctgtagtgaaaaaaatcattggagaacacggcggccgcatcagcctgagcaatcaggatgcgggtggggcgtgtgtcagaatcatcttgccaaaaacggtagaaacttatgcgtag

SEQ ID NO: 258 - protein, 706 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVFDEKGRLKTFNKAAEQILGMPLAPLWGSSRHGWHGVSAQQSLLAEVFAAIGAAAGTDKPVQVEYAAPDDAKILLGKATVLPEDNGNGVVMVIDDITVLIRAQKEAAWGEVAKRLAHEIRNPLTPIQLSAERLAWKLGGKLDDQDAQILTRSTDTIIKQVAALKEMVEAFRNYARAPSLKLENQDLNALIGDVLALYEAGPCRFEAELAGEPLMMAADTTAMRQVLHNIFKNAAEAAEEADMPEVRVKSETGQDGRIVLTVCDNGKGFGKEMLHNAFEPYVTDKPAGTGLGLPVVKKIIGEHGGRISLSNQDAGGACVRIILPKTVETYA

SEQ ID NO: 259 - DNA, 465 bp, Neisseria meningitidis
atgtacgcatttaccgccgcacagcaacagaaggcactcttccggctggtgctttttcatatcctcatcatcgccgccagcaactatctggtgcagttccctttccaaattttcggcatccacaccacttggggcgcattttcctttcccttcatcttccttgccaccgacctgaccgtccgcattttcggttctcacttggcacggcggattatcttttgggtgatgttccccgcccttttgctttcctacgtcttttccgttttgttccacaacggcagttggacaggcttgggcgcgctgtccgaattcaacacctttgtcggacgcatcgccttagccagctttgccgcctacgcgatcggacaaatccttgatatttttgtattcaacaaattacgccgtctgaaagcgtggtggattgcaccgaacgcatcaaccgtcatcgggcacgcgttggatacg

SEQ ID NO: 260 - protein, 155 aa, Neisseria meningitidis
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPNASTVIGHALDT

SEQ ID NO: 261 - DNA, 687 bp, Neisseria meningitidis
atgtacgcatttaccgccgcacagcaacagaaggcactcttccggctggtgctttttcatatcctcatcatcgccgccagcaactatctggtgcagttccctttccaaattttcggcatccacaccacttggggcgcattttcctttcccttcatcttccttgccaccgacctgaccgtccgcattttcggttctcacttggcacggcggattatcttttgggtgatgttccccgcccttttgctttcctacgtcttttccgttttgttccacaacggcagttggacaggcttgggcgcgctgtccgaattcaacacctttgtcggacgcatcgccttagccagctttgccgcctacgcgatcggacaaatccttgatatttttgtattcaacaaattacgccgtctgaaagcgtggtggattgcaccgaccgcatcaaccgtcatcggcaacgccttggatacgctggtatttttcgccgttgccttctacgcaagcagcgatggatttatggcggcaaactggcagggcatcgcttttgtcgattacctgttcaaacttaccgtctgcaccctcttcttcctgcccgcctacggcgtgatactgaatctgctgacgaaaaaactgacaaccctgcaaaccaaacaggcgcaagaccgccccgcgccctcgctgcaaaatccgtaa

SEQ ID NO: 262 - protein, 228 aa, Neisseria meningitidis
MYAFTAAQQQKALFRLVLFHILIIAASNYLVQFPFQIFGIHTTWGAFSFPFIFLATDLTVRIFGSHLARRIIFWVMFPALLLSYVFSVLFHNGSWTGLGALSEFNTFVGRIALASFAAYAIGQILDIFVFNKLRRLKAWWIAPTASTVIGNALDTLVFFAVAFYASSDGFMAANWQGIAFVDYLFKLTVCTLFFLPAYGVILNLLTKKLTTLQTKQAQDRPAPSLQNP

SEQ ID NO: 263 - DNA, 687 bp, Neisseria meningitidis
atgtacgcatttaccgccgcacagcaacagaaggcactcttctggctggtgctttttcatatcctcatcatcgccgccagcaactatctggtgcagttccccttccaaatttccggcatccacaccacttggggcgcgttttcctttcccttcatcttcctcgccaccgacctgaccgtccgcattttcggttcgcacttggcacggcggattatcttttgggtcatgttccccgcccttttgctttcctacgtcttttccgttttgttccacaacggcagttggacgggcttgggcgcgctgtccgaattcaacacctttgtcggacgcatcgcgctggcaagttttgccgcctacgcgctcggacaaatccttgatatttttgtgttcaacaaattacgccgtctgaaagcgtggtgggttgccccgactgcatcaaccgtcatcggcaacgccttagatacgttggtatttttcgccgttgccttctacgcaagcagcgatggatttatggcggcaaactggcagggcatcgcttttgtcgattacctgttcaaactcaccgtctgcggtctgtttttcctgcccgcctacggcgtgattctgaatctgctgacgaaaaaactgacgaccctgcaaaccaaacaggcgcaagaccgccccgcgccctcgctgcaaaatccgtaa

SEQ ID NO: 264 - protein, 228 aa, Neisseria meningitidis
MYAFTAAQQQKALFWLVLFHILIIAASNYLVQFPFQISGIHTTWGAFSFPFIFLATDLTVRIFGSHLARRIIFWVMFPALLLSYVFSVLFHNGSWTGLGALSEFNTFVGRIALASFAAYALGQILDIFVFNKLRRLKAWWVAPTASTVIGNALDTLVFFAVAFYASSDGFMAANWQGIAFVDYLFKLTVCGLFFLPAYGVILNLLTKKLTTLQTKQAQDRPAPSLQNP

SEQ ID NO: 265 - DNA, 687 bp, Neisseria gonorrhoeae
atgtacgcattgaccgccgcacagcaacagaaggcactcttccggctggtgcttttccatatcctcatcatcgccgccagcaactatctggtgcagttccccttccggattttcggcatccacaccacttggggcgcgttttcctttcccttcatcttcctcgccaccgacctgaccgtccgcattttcggttcgcacttggcgcggcggattatcttttgggtgatgttccccgcccttttgctttcatacgtcttttccgttttgttccacaacggcagttggacgggcttgggcgcgctgtcccaattcaacacctttgtcggacgcatcgcgctggcaagttttgccgcctacgcgctcggacaaatccttgatattttcgtattcgacaaattacgccgtctgaaagcgtggtggattgccccggccgcatcaaccgtcatcggcaatgcactggacacgttagtattttttgccgttgccttttacgcaagcagcgatgaatttatggcggcaaactggcagggcatcgcttttgtcgattacctgttcaaacttaccgtctgcaccctcttcttcctgcccgcctacggcgtgatactgaatctgctgacgaaaaaactgacggccctgcaaaccaaacaggcgcaagaccgccccgtgccctcgctgcaaaatccgtaa

SEQ ID NO: 266 - protein, 228 aa, Neisseria gonorrhoeae
MYALTAAQQQKALFRLVLFHILIIAASNYLVQFPFRIFGIHTTWGAFSFPFIFLATDLTVRIFGSHLARRIIFWVMFPALSLSYVFSVLFHNGSWTGLGAPSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 267 - DNA, 519 bp, Neisseria meningitidis
atggtcataaaatatacaaatttgaattttgcgaaattgtcgataattgcaattttgatgatgtattcgtttgaagcgaatgcaaaygcagtmwraatatctgaaactgtttcagttgataccggacaaggtgcgaaaattcataagtttgtacctaaaaatagtaaaacttattcatctgatttaataaaaacggtagatttaacacacayycctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgtaaaaggctacgaatatagtaattgcctttggtacgaagacaaaagacgtattaatagaacctatggctgctacggcgttgat

SEQ ID NO: 268 - protein, 173 aa, Neisseria meningitidis
  misc_feature (32)..(32): Xaa= any amino acid
  misc_feature (71)..(71): Xaa= any amino acid
MVIKYTNLNFAKLSIIAILMMYSFEANANAVXISETVSVDTGQGAKIHKFVPKNSKTYSSDLIKTVDLTHXPTGAKARINAKITASVSRAGVLAGVGKLARLGAKFSTRAVPYVGTALLAHDVYETFKEDIQARGYQYDPETDKFVKGYEYSNCLWYEDKRRINRTYGCYGVD

SEQ ID NO: 269 - DNA, 453 bp, Neisseria meningitidis
atggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaa

SEQ ID NO: 270 - protein, 150 aa, Neisseria meningitidis
MVIKYTNLNFAKLSIIAILMMYSFEANANAVKISETVSVDTGQGAKIHKFVPKNSKTYSSDLIKTVDLTHIPTGAKARINAKITASVSRAGVLAGVGKLARLGAKFSTRAVPYVGTALLAHDVYETFKEDIQARGYQYDPETDKFAKVSG

SEQ ID NO: 271 - DNA, 453 bp, Neisseria meningitidis; identical to SEQ ID NO: 269

SEQ ID NO: 272 - protein, 150 aa, Neisseria meningitidis; identical to SEQ ID NO: 270

SEQ ID NO: 273 - DNA, 8 bp, Neisseria gonorrhoeae
  misc_feature (1)..(8): N= Unknown
nnnnnnnn

SEQ ID NO: 274 - protein, 526 aa, Neisseria gonorrhoeae
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKFVKGYEYANCLWYEDERRINRTYGCYGVDSSIMRLMPDRSRFPEVKQLMESQMYRLARPFWNWRKEELNKLSSLDWNNFVLNRCTFDWNGGGCAVNKGDDFRAGASFSLGRNPKYKEEMDAKKPEEILSLKVDADPDKYIEATGYPGYSEKVEVAPGTKVNMGPVTDRNGNPVQVAATFGRDAQGNTTADVQVIPRPDLTPASAEAPHAQPLPEVSPAENPANNPDPDENPGTRPNPEPDPDLNPDANPDTDGQPGTSPDSPAVPDRPNGRHRKERKEGEDGGLSCDYFPEILACQEMGKPSDRMFHDISIPQVTDDKTWSSHNFLPSNGVCPQPKTFHVFGRQYRASYEPLCVFAEKIRFAVLLAFIIMSAFVVFGSLGGE

SEQ ID NO: 275 - DNA, 435 bp, Neisseria gonorrhoeae
atggtcacaaaacatacaaatttgaattttgcgaaattgtcgataattgcaattttgatgatgtattcgtttgaagcgaatgcaaatgcagtaaaaatatctgaaactctttcggttgataccggacaaggcgcgaaagttcataagttcgttcctaaatcaagtaatatttattcatctgatttaacaaaagcggtagatttaacgcatatccccacgggcgcaaaagcccgaatcaacgccaaaataaccgccagcgtatcccgcgccggcgtattgtcgggggtcggcaaacttgtccgccaaggcgcgaaattcggcacaagggcggttccctatgtcggaacagcccttttagcccacgacgtatacgaaactttcaaagaagacatacaggcacgaggctgccgatacgatcccgaaaccgacaaattt

SEQ ID NO: 276 - protein, 145 aa, Neisseria gonorrhoeae
MVTKHTNLNFAKLSIIAILMMYSFEANANAVKISETLSVDTGQGAKVHKFVPKSSNIYSSDLTKAVDLTHIPTGAKARINAKITASVSRAGVLSGVGKLVRQGAKFGTRAVPYVGTALLAHDVYETFKEDIQARGCRYDPETDKF

SEQ ID NO: 277 - DNA, 229 bp, Neisseria meningitidis
atgagatttttcggtatcggttttttggtgctgctgtttttggagattatgtcgattgtgtgggttgccgattggctgggcggcggctggacgttgtttttgatggcggcaggttttgccgccggcgtgctgatgctcaggcaaaccggggctgaccggtcttttattggcgggcgcggcaatgagaagcggcgggaaggtatccgtttatcagatgttgtggcctatc

SEQ ID NO: 278 - protein, 76 aa, Neisseria meningitidis
MRFFGIGFLVLLFLEIMSIVWVADWLGGGWTLFLMAAGFAAGVLMLRQTGLTGLLLAGAAMRSGGKVSVYQMLWPI

SEQ ID NO: 279 - DNA, 486 bp, Neisseria meningitidis
atgagatttttcggtatcggttttttggtgctgctgtttttggagattatgtcgattgtgtgggttgccgattggctgggcggcggctggacgttgtttttgatggcggcaggttttgccgccggcgtgctgatgctcaggcatacggggctgtccggtcttttattggcgggcgcggcaatgagaagcggcgggagggtatccgtttatcagatgttgtggcctatccgttatacggtggcggctgtgtgtctgatgagtccgggattcgtatcctcggtgttggcggtattgctgctgctgccgtttaagggaggggcagtgttgcaggcaggaggtgcggaaaattttttcaacatgaaccaatcgggcagaaaagagggcttttcccgcgatgacgatattatcgagggagaatatacggttgaagagccttacggcggcaatcgttcccgaaacgccatcgaacacaaaaaagacgaataa

SEQ ID NO: 280 - protein, 161 aa, Neisseria meningitidis
MRFFGIGFLVLLFLEIMSIVWVADWLGGGWTLFLMAAGFAAGVLMLRHTGLSGLLLAGAAMRSGGRVSVYQMLWPIRYTVAAVCLMSPGFVSSVLAVLLLLPFKGGAVLQAGGAENFFNMNQSGRKEGFSRDDDIIEGEYTVEEPYGGNRSRNAIEHKKDE

SEQ ID NO: 281 - DNA, 486 bp, Neisseria meningitidis
  misc_feature (213)..(213): N= Unknown
  misc_feature (224)..(224): N= Unknown
  misc_feature (254)..(254): N= Unknown
  misc_feature (284)..(284): N= Unknown
  misc_feature (298)..(298): N= Unknown
  misc_feature (303)..(303): N= Unknown
  misc_feature (366)..(366): N= Unknown
  misc_feature (381)..(381): N= Unknown
  misc_feature (385)..(385): N= Unknown
  misc_feature (432)..(432): N= Unknown
  misc_feature (446)..(446): N= Unknown
  misc_feature (463)..(463): N= Unknown
  misc_feature (465)..(465): N= Unknown
atgagatttttcggtatcggttttttggtgctgctgtttttggagattatgtcgattgtgtgggttgccgattggttgggcggcggttggacgctgtttctaatggcggcaacctttgccgccggcgtggtgatgctcaggcatacggggctgtccggtcttttattggcgggcgcggcaatgagaagcggcgggagggtatccgtttatcanatgttgtggcntatccgttatacggtggcggcggtgtgtcngatgagtccgggattcgtatcctcggtgtnggcggtattgctgntgctnccgtttaagggaggtgcagtgttgcaggcaggaggtgcggaaaattttttcaacatgaaccantcgggcagaaaaganggcntttcccgcgatgacgatattatcgagggggaatatacggttgaaganccttacggcggcantcgtttccgaaacgccntngaacacaaaaaagacgaataa

SEQ ID NO: 282 - protein, 161 aa, Neisseria meningitidis
  misc_feature (71)..(71): Xaa= any amino acid
  misc_feature (75)..(75): Xaa= any amino acid
  misc_feature (85)..(85): Xaa= any amino acid
  misc_feature (95)..(95): Xaa= any amino acid
  misc_feature (100)..(100): Xaa= any amino acid
  misc_feature (122)..(122): Xaa= any amino acid
  misc_feature (127)..(127): Xaa= any amino acid
  misc_feature (129)..(129): Xaa= any amino acid
  misc_feature (144)..(144): Xaa= any amino acid
  misc_feature (149)..(149): Xaa= any amino acid
  misc_feature (155)..(155): Xaa= any amino acid
MRFFGIGFLVLLFLEIMSIVWVADWLGGGWTLFLMAATFAAGVVMLRHTGLSGLLLAGAAMRSGGRVSVYXMLWXIRYTVAAVCXMSPGFVSSVXAVLLXLPFKGGAVLQAGGAENFFNMNXSGRKXGXSRDDDIIEGEYTVEXPYGGXRFRNAXEHKKDE

SEQ ID NO: 283 - DNA, 486 bp, Neisseria gonorrhoeae
atgagatttttcggtatcggttttttggtgctgctgtttttggaaattatgtcgattgtgtgggttgccgattggctgggcggcggttggacgctgtttctaatggcggcaacctttgccgccggtgtgctgatgctcaggcatacggggctgtccggtcttttattggctggcgcggcggtaaaaagtagtgggaaggtatctgtttatcagatgttgtggcctatccgttatacggtggcggcggtgtgtctgatgagtccgggattcgtatcctccgtgttggcggtattgctgctgctgccgtttaagggaggggcagtgttgcaggcaggaggtgcggaaaattttttcaacatgaaccaatcgggcagaaaagagggatttttccacgatgacgatattatcgagggagaatatacggttgaaaaacctgacggcggcaatcgttcccgaaacgccatcgaacacgaaaaagacgaataa

SEQ ID NO: 284 - protein, 161 aa, Neisseria gonorrhoeae
MRFFGIGFLVLLFLEIMSIVWVADWLGGGWTLFLMAATFAAGVLMLRHTGLSGLLLAGAAVKSSGKVSVYQMLWPIRYTVAAVCLMSPGFVSSVLAVLLLLPFKGGAVLQAGGAENFFNMNQSGRKEGFFHDDDIIEGEYTVEKPDGGNRSRNAIEHEKDE

SEQ ID NO: 285 - DNA, 862 bp, Neisseria meningitidis
atgtttgtttttcagacggcattcttatgtttcagaaacatttgcagaaagcctccgacagcgtcgtcggagggacattatacgtggttgccacgcccatcggcaatttggcggacattaccctgcgcgctttggcggtattgcaaaaggcggccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaacgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcagcgcttgccgatatggcggaactgttccccgaacgccgattaatgctggcgcgcgaaattacgaaaacgtttgaaacgttcttaagcggcacggttggggaaattcagacggcattgtctgccgacggcgaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgat

SEQ ID NO: 286 - protein, 288 aa, Neisseria meningitidis
  misc_feature (9)..(9): Xaa= any amino acid
  misc_feature (132)..(132): Xaa= any amino acid
MFVFQTAFXMFQKHLQKASDSVVGGTLYVVATPIGNLADITLRALAVLQKAAEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 287 - DNA, 876 bp, Neisseria meningitidis
atgtttcagaaacatttgcagaaagcctccgacagcgtcgtcggagggacattatacgtggttgccacgcccatcggcaatttggcggacattaccctgcgcgctttggcggtattgcaaaaggcggacatcatctgtgccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaagcgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcgacgcttgccgatatggcggaactgttccccgaacgccgattaatgctggcgcgcgaaattacgaaaacgtttgaaacgttcttaagcggcacggttggggaaattcagacggcattgtctgccgacggcaaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgatctggctctgtcttggaaaaacaaatag

SEQ ID NO: 288 - protein, 291 aa, Neisseria meningitidis
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREAGFKVVPVVGASAVMAALSVAGVEGSDFYFNGFVPPKSGERRKLFAKWVRAAFPIVMFETPHRIGATLADMAELFPERRLMLAREITKTFETFLSGTVGEIQTALSADGNQSRGEMVLVLYPAQDEKHEGLSESAQNIMKILTAELPTKQAAELAAKITGEGKKALYDLALSWKNK

SEQ ID NO: 289 - DNA, 876 bp, Neisseria meningitidis
atgtttcagaaacatttgcagaaagcctccgacagcgtcgtcggagggacattatacgtggttgccacgcccatcggcaatttggcggacattaccctgcgcgctttggcggtattgcaaaaggcggacatcatctgtgccgaagacacgcgcgttaccgcgcagcttttgagcgcgtacggcattcagggcaaactcgtcagcgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggtcgggtttaaagttgtccctgttgtcggcgcaagcgcggtgatggcggctttgagtgtggctggtgtggcgggatccgatttttatttcaacggttttgtaccgccgaaatcgggcgaacgtaggaaattgtttgccaaatgggtgcgggtggcgtttcccgtcgtgatgtttgaaacgccgcaccgcatcggggcgacgcttgccgatatggcggaactgttccccgaacgccgattaatgctggcgcgcgaaatcacgaaaacgtttgaaacgttcttaagcggcacggttggggaaattcagacggcattggcggcggacggcaaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgccgccaaaatcacgggcgagggaaaaaaagctttgtacgatctggcactgtcttggaaaaacaaatga

SEQ ID NO: 290 - protein, 291 aa, Neisseria meningitidis
MFQKHLQKASDSVVGGTLYVVATPIGNLADITLRALAVLQKADIICAEDTRVTAQLLSAYGIQGKLVSVREHNERQMADKIVGYLSDGMVVAQVSDAGTPAVCDPGAKLARRVREVGFKVVPVVGASAVMAALSVAGVAGSDFYFNGFVPPKSGERRKLFAKWVRVAFPVVMFETPHRIGATLADMAELFPERRLMLAREITKTFETFLSGTVGEIQTALAADGNQSRGEMVLVLYPAQDEKHEGLSESAQNIMKILTAELPTKQAAELAAKITGEGKKALYDLALSWKNK

SEQ ID NO: 291 - DNA, 8 bp, Neisseria gonorrhoeae
  misc_feature (1)..(8): N= Unknown
nnnnnnnn

SEQ ID NO: 292 - protein, 300 aa, Neisseria gonorrhoeae
MSVFQTAFFMFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 293 - DNA, 876 bp, Neisseria gonorrhoeae
atgtttcagaaacacttgcagaaagcctccgacagcgtcgtcggagggacattatacgtggttgccacgcccatcggcaatttggcagacattaccctgcgcgctttggcggtattgcaaaaggcggacatcatttgtgccgaagacacgcgcgttactgcgcagcttttgagcgcgtacggcattcagggcaggttggtcagtgtgcgcgaacacaacgagcggcagatggcggacaaggtaatcggtttcctttcagacggcctggttgtggcgcaggtttccgatgcgggtacgccggccgtgtgcgacccgggcgcgaaactcgcccgccgcgtgcgcgaagcagggttcaaagtcgttcccgtcgtgggcgcaagcgcggtaatggcggcgttgagtgtggccggtgtggcggaatccgatttttatttcaacggttttgtaccgccgaaatcgggcgaacgtaggaaattgtttgccaaatgggtgcgggcggcatttcctgtcgtcatgtttgaaacgccgcaccgaatcggggcaacgcttgccgatatggcggaattgttccccgaacgccgtctgatgctggcgcgcgaaatcacgaaaacgtttgaaacgttcttaagcggcacggttggggaaattcagacggcattggcggcggacggcaaccaatcgcgcggcgagatggtgttggtgctttatccggcgcaggatgaaaaacacgaaggcttgtccgagtctgcgcaaaatgcgatgaaaatccttgcggccgagctgccgaccaagcaggcggcggagcttgccgccaagattacaggtgagggcaaaaaggctttgtacgatttggcactgtcgtggaaaaacaaatga

SEQ ID NO: 294 - protein, 291 aa, Neisseria gonorrhoeae
MFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 295 - DNA, 185 bp, Neisseria meningitidis
atgaaacagaaaaaaaccgctgccgcagttattgctgcaatgttggcaggttttgcggcagcaaagcacccgaaatcgacccggctttggagttggtcagaaaccagttggagcagggtttgagacaggaaaaagcccgcttgaaaatcgatgcccttttggaagaaaacggtgtcaaaccgtaa

SEQ ID NO: 296 - protein, 60 aa, Neisseria meningitidis
  misc_feature (21)..(21): Xaa= any amino acid
MKQKKTAAAVIAAMLAGFAAXKAPEIDPALELVRNQLEQGLRQEKARLKIDALLEENGVK

SEQ ID NO: 297 - DNA, 759 bp, Neisseria meningitidis
atgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaa

SEQ ID NO: 298 - protein, 252 aa, Neisseria meningitidis
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSEDELHKFYEQQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDALLEENGVKP

SEQ ID NO: 299 - DNA, 759 bp, Neisseria meningitidis
atgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgtcggctgcaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaaagcgcactgcgtcagttttatgagcggcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgcagcgatgaatcggggcgacgttacccgcgatccggtcaaattgggcgaacgctattatctgttcaaactcagcgaggtcgggaaaaaccccgacgcgcagcctttcgagttggtcagaaaccagttggaacaaggtttgagacaggaaaaagcccgcttgaaaatcgatgccattttggaagaaaacggtgtcaaaccgtaa

SEQ ID NO: 300 - protein, 252 aa, Neisseria meningitidis
MKQKKTAAAVIAAMLAGFAAAKAPEIDPALVDTLVAQIMQQADRHAEQSQKPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAAMNRGDVTRDPVKLGERYYLFKLSEVGKNPDAQPFELVRNQLEQGLRQEKARLKIDAILEENGVKP

SEQ ID NO: 301 - DNA, 759 bp, Neisseria gonorrhoeae
atgaaacagaaaaagaccgctgccgcagttattgctgcaatgttggcaggttttgcggcagccaaagcacccgaaatcgacccggctttggtggatacgctggtggcgcagatcatgcagcaggcagaccggcatgcggagcagtcccaaagaccggacgggcaggcaatccgaaacgatgccgtccgccggctgcaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaaagcgcactgcgtcagttttatgagcggcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcgttcgacggtttcattatggcgcagcagcttcccgagccgctggcttcgcagtttgccggtatgaaccgtggcgacgttacccgcaatccggtcaaattgggcgaacgctattacctgttcaaactcggcgcggtcgggaaaaaccccgacgcgcagcctttcgagttggtcagaaaccagttggaacaaggtttgaggcaggaaaaagcccgcttgaaaatcgatgcccttttggaagaaaacggtgtcaaaccgtaa

SEQ ID NO: 302 - protein, 252 aa, Neisseria gonorrhoeae
MKQKKTAAAVIAAMLAGFAAAKAPEIDPALVDTLVAQIMQQADRHAEQSQRPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAGMNRGDVTRNPVKLGERYYLFKLGAVGKNPDAQPFELVRNQLEQGLRQEKARLKIDALLEENGVKP

SEQ ID NO: 303 - DNA, 622 bp, Neisseria meningitidis
atgaaaaaatctttccttacgcttgttctgtattcgtctttacttaccgccagcgaaattgccttaccccttggaattggggattgaaaccttaccggcggcaaaaattgcggaaacgtttgcgctgacatttgtgattgctgcgctgtatctgtttgcgcgtaataaggtgacgcgtttgttgattgcggtgttttttgcgttcagcattattgccaacaatgtgcattacgcggattatcaaagctggatgacgcaaaccgtattcgagcagctgcaaaagactcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 304 - protein, 206 aa, Neisseria meningitidis
MKKSFLTLVLYSSLLTASEIAYPLELGIETLPAAKIAETFALTFVIAALYLFARNKVTRLLIAVFFAFSIIANNVHYADYQSWMTQTVFEQLQKTPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 305 - DNA, 1575 bp, Neisseria meningitidis
atgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 306 - protein, 524 aa, Neisseria meningitidis
MKKSFLTLVLYSSLLTASEIAYRFVFGIETLPAAKIAETFALTFVIAALYLFARYKVTRLLIAVFFAFSIIANNVHYAVYQSWMTGINYWLMLKEVTEVGSAGASMLDKLWLPVLWGVLEVMLFCSLAKFRRKTHFSADILFAFLMLMIFVRSFDTKQEHGISPKPTYSRIKANYFSFGYFVGRVLPYQLFDLSRIPAFKQPAPSKIGQGSVQNIVLIMGESESAAHLKLFGYGRETSPFLTRLSQADFKPIVKQSYSAGFMTAVSLPSFFNAIPHANGLEQISGGDTNMFRLAKEQGYETYFYSAQAENEMAILNLIGKKWIDHLIQPTQLGYGNGDNMPDEKLLPLFDKINLQQGKHFIVLHQRGSHAPYGALLQPQDKVFGEADIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 307 - DNA, 1275 bp, Neisseria meningitidis
atgaaaaaatcccttttcgttctctttctgtattcgtccctacttactgccagcgaaattgcttatcgctttgtattcggaattgaaaccttaccggctgcaaaaatggcagaaacgtttgcgctgacatttgtgattgctgcgctgtatctgtttgcgcgttataaggcaacgcgtttgttgattgcggtgtttttcgcgttcagcattattgccaacaatgtgcattacgcggtttatcaaagctggataacgggcattaattattggctgatgctgaaagagattaccgaagttggcggcgcaggggcgtcgatgttggataagttgtggctgcctgcgttgtggggcgtgttggaagtcatgttgttttgcagccttgccaagttccgccgtaagacgcatttttctgccgatatactgtttgccttcctaatgctgatgattttcgtgcgttcgttcgacacgaaacaagaacacggtatttcgcccaaaccgacatacagccgcatcaaagccaattatttcagcttcggttattttgtcggacgcgtgttgccgtatcagttgtttgatttaagcaagattcctgtgttcaaacagcctgctccaagcagaatcgggcaaggcagtattcaaaatatcgtcctgattatgggcgaaagcgaaagcgcggcgcatttgaaattgtttggctacgggcgcgaaacttcgccgtttttgacccagctttcgcaagccgattttaagccgattgtgaaacaaagttattccgcaggctttatgacggcagtatccctgcccagtttctttaacgtcataccgcatgccaacggcttggaacaaatcagcggcggcgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctggtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 308 - protein, 424 aa, Neisseria meningitidis
MKKSLFVLFLYSSLLTASEIAYRFVFGIETLPAAKMAETFALTFVIAALYLFARYKATRLLIAVFFAFSIIANNVHYAVYQSWITGINYWLMLKEITEVGGAGASMLDKLWLPALWGVLEVMLFCSLAKFRRKTHFSADILFAFLMLMIFVRSFDTKQEHGISPKPTYSRIKANYFSFGYFVGRVLPYQLFDLSKIPVFKQPAPSRIGQGSIQNIVLIMGESESAAHLKLFGYGRETSPFLTQLSQADFKPIVKQSYSAGFMTAVSLPSFFNVIPHANGLEQISGGDIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 309 - DNA, 1575 bp, Neisseria gonorrhoeae
atgaaaaaatcccttttcgttctctttctgtattcatccctacttaccgccagcgaaatcgcctatcgctttgtattcggaattgaaaccttaccggctgcaaaaatggcggaaacgtttgcgctgacatttatgattgctgcgctgtatctgtttgcgcgttataaggcttcgcggctgctgattgcggtgtttttcgcgttcagcatgattgccaacaatgtgcattacgcggtttatcaaagctggatgacgggtattaactattggctgatgctgaaagaggttaccgaagtcggcagcgcgggcgcgtcgatgttggataagttgtggctgcctgctttgtggggcgtggcggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcgggcgcgtgttgccgtatcagttgtttgatttaagcaagatccctgtgttcaaacagcctgctccaagcaaaatcgggcaaggcagtattcaaaatatcgtcctgattatgggcgaaagcgaaagcgcggcgcatttgaaattgtttggttacgggcgcgaaacttcgccgtttttaacccggctgtcgcaagccgattttaagccgattgtgaaacaaagttattccgcaggctttatgacggcagtatccctgcccagtttctttaacgtcataccgcacgccaacggcttggaacaaatcagcggcggcgataccaatatgttccgcctcgccaaagagcagggctatgaaacgtatttttacagtgcccaggctgaaaaccaaatggcaattttgaacttaatcggtaagaaatggatagaccatctgattcagccgacgcaacttggctacggcaacggcgacaatatgcccgatgagaagctgctgccgttgttcgacaaaatcaatttgcagcagggcaggcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgtgcgccaagatatctacaatcaaggcacggtgcagcccgacagctatattgtgcctctggttttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacaggcaacctgattacgggcgatgcaggcagcttgaacattcgcaacggcaaggcggaatatgtttatccgcaataa

SEQ ID NO: 310 - protein, 524 aa, Neisseria gonorrhoeae
MKKSLFVLFLYSSLLTASEIAYRFVFGIETLPAAKMAETFALTFMIAALYLFARYKASRLLIAVFFAFSMIANNVHYAVYQSWMTGINYWLMLKEVTEVGSAGASMLDKLWLPALWGVAEVMLFCSLAKFRRKTHFSADILFAFLMLMIFVRSFDTKQEHGISPKPTYSRIKANYFSFGYFVGRVLPYQLFDLSKIPVFKQPAPSKIGQGSIQNIVLIMGESESAAHLKLFGYGRETSPFLTRLSQADFKPIVKQSYSAGFMTAVSLPSFFNVIPHANGLEQISGGDTNMFRLAKEQGYETYFYSAQAENQMAILNLIGKKWIDHLIQPTQLGYGNGDNMPDEKLLPLFDKINLQQGRHFIVLHQRGSHAPYGALLQPQDKVFGEADIVDKYDNTIHKTDQMIQTVFEQLQKQPDGNWLFAYTSDHGQYVRQDIYNQGTVQPDSYIVPLVLYSPDKAVQQAANQAFAPCEIAFHQQLSTFLIHTLGYDMPVSGCREGSVTGNLITGDAGSLNIRNGKAEYVYPQ

SEQ ID NO: 311 - DNA, 590 bp, Neisseria meningitidis
accctgctcctcttcatccccctcgtcctcacacgtgcggcacactgaccggcatactcgcccacggcggcggcaaacgctttgccgtcgaacaagaactcgtcgccgcatcgtcccgcgccgccgtcaaagaaatggatttgtccgccytaaaaggacgcaaagccgccytttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgycytgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgratacgccgacaccgacgtattcgtaaccgtcgacgta

SEQ ID NO: 312 - protein, 197 aa, Neisseria meningitidis
  misc_feature (12)..(12): Xaa= any amino acid
  misc_feature (58)..(58): Xaa= any amino acid
  misc_feature (128)..(128): Xaa= any amino acid
  misc_feature (185)..(185): Xaa= any amino acid
TLLLFIPLVLTXCGTLTGILAHGGGKRFAVEQELVAASSRAAVKEMDLSALKGRKAAXYVSVMGDQGSGNISGGRYSIDALIRGGYHNNPESATQYSYPAYDTTATTKSDALSSVTTSTSLLNAPAAXLTKNSGRKGERSAGLSVNGTGDYRNETLLANPRDVSFLTNLIQTVFYLRGIEVVPPXYADTDVFVTVDV

SEQ ID NO: 313 - DNA, 942 bp, Neisseria meningitidis
atgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataa

SEQ ID NO: 314 - protein, 313 aa, Neisseria meningitidis
MKTLLLLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLITPKTAAYESQYQEQYALWTGPYKVSKTVKASDRLMVDFSDITPYGDTTAQNRPDFKQNNGKKPDVGNEVIRRRKGG

SEQ ID NO: 315 - DNA, 942 bp, Neisseria meningitidis
  misc_feature (16)..(16): N= Unknown
atgaaaaccctgctcntcctcatccccctcgtcctcacagcctgcggcacactgaccggcatacccgcccacggcggcggcaaacgctttgccgtcgaacaagaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgcaccgaactgcacctctacaacgccgaaacccttaaagcccaaaccaagctcgaatatttcgccgttgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaacccgatgtcggcaacgaagtcatccgccgccgcaaaggaggataa

SEQ ID NO: 316 - protein, 313 aa, Neisseria meningitidis
  misc_feature (6)..(6): Xaa= any amino acid
MKTLLXLIPLVLTACGTLTGIPAHGGGKRFAVEQELVAASSRAAVKEMDLSALKGRKAALYVSVMGDQGSGNISGGRYSIDALIRGGYHNNPESATQYSYPAYDTTATTKSDALSSVTTSTSLLNAPAAALTKNSGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKKPDVGNEVIRRRKGG

SEQ ID NO: 317 - DNA, 942 bp, Neisseria gonorrhoeae
atgaaaaccctgctcctcctcatccccctcgtactcaccgcctgcggcacactgaccggcatacccgcccacggcggcggcaaacgctttgccgtcgaacaggaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactccatcgacgcactgatacgcggcggctaccacaacaaccccgacagcgccacccgatacagctaccccgcctatgacactaccgccaccaccaaatccgacgcgctctccggcgtaaccacttccacatcgcttttgaacgcccccgccgccgccctgacgaaaaacaacggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgtcgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaccccgatgtcggcaacgaagtcatccgccgccgcaaaggaggataa

SEQ ID NO: 318 - protein, 313 aa, Neisseria gonorrhoeae
MKTLLLLIPLVLTACGTLTGIPAHGGGKRFAVEQELVAASSRAAVKEMDLSALKGRKAALYVSVMGDQGSGNISGGRYSIDALIRGGYHNNPDSATRYSYPAYDTTATTKSDALSGVTTSTSLLNAPAAALTKNNGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKNPDVGNEVIRRRKGG

SEQ ID NO: 319 - DNA, 1191 bp, Neisseria meningitidis
atggcagagatctgtttgataaccggcacgcccggttcagggaaaacattaaaaatggtttccatgatggcgaatgatgaaatgtttaagcctgatgaaaaagccatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtaysrrtmmgcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgraagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgccaaggactatgtaaaaaacggcttgccgtttaacccatacaaagaagaaagccaagggcaggaagttcagcaaagcgcgcagcaacattcggacagggcgccaagttgccacattgggcggaaaaccgtagcagaacctaatgtacgataattgggaagaacgcgggaaaccgtttgaaggaatcggacgggggcgtggtcggatcggcaaactga

SEQ ID NO: 320 - protein, 395 aa, Neisseria meningitidis
  misc_feature (190)..(191): Xaa= any amino acid
  misc_feature (279)..(279): Xaa= any amino acid
  misc_feature (368)..(368): Xaa= any amino acid
MAEICLITGTPGSGKTLKMVSMMANDEMFKPDEKAIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYXXAEVHTVNKVKRSKWFYTLPVIVLLIPVFVGLSYKMLSSYGKKQEEPAAQESAATEQQAVLPDKTEGEPVNNGNLTADMFVPTLSEKPXSKPIYNGVRQVRTFEYIAGCIEGGRTGCACYSHQGTALKEVTELMCKDYVKNGLPFNPYKEESQGQEVQQSAQQHSDRAQVATLGGKPXQNLMYDNWEERGKPFEGIGGGVVGSAN

SEQ ID NO: 321 - DNA, 1188 bp, Neisseria meningitidis
atggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactga

SEQ ID NO: 322 - protein, 394 aa, Neisseria meningitidis
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYESAEVHTVNKVKRSKWFYTLPVIVLLIPVFVGLSYKMLSSYGKKQEEPAAQESAATEQQAVLPDKTEGEPVNNGNLTADMFVPTLSEKPESKPIYNGVRQVRTFEYIAGCIEGGRTGCACYSHQGTALKEVTELMCKDYVKNGLPFNPYKEESQGQEVQQSAQQHSDRAQVATLGGKPQNLMYDNWEERGKPFEGIGGGVVGSAN

SEQ ID NO: 323 - DNA, 1188 bp, Neisseria meningitidis
atggcagagatctgtttgataaccggcacgcccggttcagggaaaacattaaaaatggtttccatgatggcaaacgatgaaatgtttaagccggatgaaaacggcatacgccgtaaagtatttacgaacatcaaaggcttgaagataccgcacacctacatagaaacggacgcgaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggctctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaaatggttttatactctgccagtaataatattgctgattcccgtttttgtcggcctgtcctataaaatgttaagtagttatggaaaaaaacaggaagaacccgcagcacaagaatcggcggcaacagaacatcaggcagtatttcaggataaaacagaaggcgagccggtaaacaacggtaaccttaccgcagatatgtttgttccgacattgtccgaaaaacccgaaagcaagccgatttataacggtgtaaggcaggtaagaacctttgaatatatagcaggctgtgtagaaggcggaagaaccggatgcacatgctattcgcatcaagggacggcattgaaagaaattacaaaggaaatgtgcaaggattacgcaagaaacggattgccgtttaacccatataaagaagaaagccaagggcgggatgtccagcaaagtgagcagcaccattcggacagaccgcaagttgccacgttgggcggaaagccgtggcaaaatcttatgtatgataattggcaggagcgcggaaaaccgtttgaaggaatcggcgggggcgtggtcggatcggcaaactga

SEQ ID NO: 324 - protein, 395 aa, Neisseria meningitidis
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGSKLLDQNLRTLVRKHYHIASNKMGMRTLLEWKICADDPVKMASSAFSSIYTLDKKVYDLYESAEVHTVNKVKRSKWFYTLPVIILLIPVFVGLSYKMLSSYGKKQEEPAAQESAATEHQAVFQDKTEGEPVNNGNLTADMFVPTLSEKPESKPIYNGVRQVRTFEYIAGCVEGGRTGCTCYSHQGTALKEITKEMCKDYARNGLPFNPYKEESQGRDVQQSEQHHSDRPQVATLGGKPWQNLMYDNWQERGKPFEGIGGGVVGSAN

SEQ ID NO: 325 - DNA, 1188 bp, Neisseria gonorrhoeae
atggcagaaatctgtttgataaccggcacgcccggttcagggaaaacattaaaaatggtttccatgatggcaaacgatgaaatgtttaagccagatgaaaacggcgtacgccgtaaagtatttacgaacatcaaaggtttgaagataccgcacacccacatagaaacagacgcaaagaagctgccgaaatcaaccgatgaacagctttcggcgcatgatatgtatgaatggatcaagaagcctgaaaacgtcggcgcaatcgttattgtcgatgaggcgcaagacgtatggcccgcacgctccgcaggttcgaaaatccccgaaaacgtccaatggctgaacacacacaggcatcagggcatagatatatttgtattgacacaaggtcctaaactcttagatcagaacttgcgaacattggttaaaagacattaccacattgcggccaacaaaatgggtttgcgtaccctgcttgaatggaaagtatgcgcggatgacccggtaaaaatggcatcaagtgcattttccagtatctacacactggataaaaaagtttatgacttgtacgaatccgcagaaattcacacggtaaacaaagtcaagcgttcaaaatggttttatgcattgcccgtcatcatattattgattccgctatttgtcggtttgtcttacaaaatgttgggcagttacggaaaaaaacaggaagaacccgcagcacaagaatcggcggcaacagaacagcaggcagtacttccggataaaacagaaggagaatcggtgaataacggaaaccttacggcagatatgtttgttccgacattgcccgaaaaacccgaaagcaagccgatttataacggtgtaaggcaggtaaggacctttgaatatatagcaggctgtatagaaggcggaagaaccggatgcacctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccaccttgggcggaaaaccgcagcagaacctaatgtacgacaattgggaagaacgcgggaaaccgtttgaaggaatcggcgggggcgtggtcggatcggcaaactga

SEQ ID NO: 326 - protein, 395 aa, Neisseria gonorrhoeae
MAEICLITGTPGSGKTLKMVSMMANDEMFKPDENGVRRKVFTNIKGLKIPHTHIETDAKKLPKSTDEQLSAHDMYEWIKKPENVGAIVIVDEAQDVWPARSAGSKIPENVQWLNTHRHQGIDIFVLTQGPKLLDQNLRTLVKRHYHIAANKMGLRTLLEWKVCADDPVKMASSAFSSIYTLDKKVYDLYESAEIHTVNKVKRSKWFYALPVIILLIPLFVGLSYKMLGSYGKKQEEPAAQESAATEQQAVLPDKTEGESVNNGNLTADMFVPTLPEKPESKPIYNGVRQVRTFEYIAGCIEGGRTGCTCYSHQGTALKEVTELMCKDYVKNGLPFNPYKEESQGQEVQQSAQQHSDRAQVATLGGKPQQNLMYDNWEERGKPFEGIGGGVVGSAN

SEQ ID NO: 327 - DNA, 1091 bp, Neisseria meningitidis
gtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgcccgatgtccgcgccgttactcaggaaggtcacaaatacaccaattaccgtatccgtgatgcgccaggccaggcggtcgaatataaaaactatatgctgccggttttgcaggaacaggattatttttggattaccggcacgcgcagcgcttgcagcagcaataccgctggctgcgtatccccttggacaagcagttgaaagcggacacctttatggcattgcgtgagtttttgaaagatggggaagggcgcaaacgtctgttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccggtccgcttttggtctatctc

SEQ ID NO: 328 - protein, 371 aa, Neisseria meningitidis
  misc_feature (160)..(165): Xaa= any amino acid
  misc_feature (200)..(200): Xaa= any amino acid
  misc_feature (237)..(237): Xaa= any amino acid
  misc_feature (308)..(308): Xaa= any amino acid
  misc_feature (364)..(364): Xaa= any amino acid
MVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLPDVRAVTQEGHKYTNXXXXXXYRIRDAPGQAVEYKNYMLPVLQEQDYFWITGTRSXLQQQYRWLRIPLDKQLKADTFMALREFLKDGEGRKRXVADATKGAPAEIREQFMLAAENTLNIFAQKGYLGLDEFITSNIPKEQQDKMQGYFYEMLYGVMNAALDETXTRYGLPEWQQDEARNRFLLHSMDAYTGLTEYPAPMLLQLDGFSEVRSSGLQMTRSXGPLLVYL

SEQ ID NO: 329 - DNA, 2016 bp, Neisseria meningitidis
atgagtaaatcccgtagatctcccccacttctttcccgtccgtggttcgcttttttcagctccatgcgctttgcagtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 330 - protein, 671 aa, Neisseria meningitidis
MSKSRRSPPLLSRPWFAFFSSMRFAVALLSLLGIASVIGTVLQQNQPQTDYLVKFGSFWAQIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIVPDNQAVYAKDFKPESILGASNLSFRGNVNISEGQSADVVFLNADNGILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 331 - DNA, 2016 bp, Neisseria meningitidis
atgagtaaatcccgtagatctcccccacttctttcccgtccgtggttcgcttttttcagctccatgcgctttgcggtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgcgattttgccagtgatattgaagtaacggataaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagtttacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 332 - protein, 671 aa, Neisseria meningitidis; identical to SEQ ID NO: 330

SEQ ID NO: 333 - DNA, 8 bp, Neisseria gonorrhoeae
  misc_feature (1)..(8): N= Unknown
nnnnnnnn

SEQ ID NO: 334 - protein, 434 aa, Neisseria gonorrhoeae
  misc_feature (398)..(398): Xaa= any amino acid
MVFLNADNGMLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNXKIRFAMSSARSERDLQKEFPKHVESLQRLGKDLNHD

SEQ ID NO: 335 - DNA, 2016 bp, Neisseria gonorrhoeae
atgagtaaatcccgtatatctcccacacttctttcccgtccgtggttcgcttttttcagctccatgcgctttgcggtcgctttgctcagtctgctgggtattgcatcggttatcggcacggtgttacagcaaaaccagccgcagacggattatttggtcaaattcggaccgttttggactcggatttttgattttttgggtttgtatgatgtctatgcttcggcatggtttgtcgttatcatgatgtttctggtggtttctaccagtttgtgtttaatccgtaacgttccgccgttttggcgcgaaatgaagtctttccgggaaaaggttaaagaaaaatctctggcggcgatgcgccattcttcgctgttggatgtaaaaattgcccccgaagttgccaaacgttatctggaggtgcggggttttcagggaaaaaccgtcagccgtgaggacgggtcggttctgattgccgccaaaaaaggcacaatgaacaaatggggctatatctttgcccaagtagctttgattgtcatttgcctgggcgggttgatagacagtaacctgctgctgaagctgggtatgctggccggtcggattgttccggacaatcaggcggtttatgccaaggatttcaagcccgaaagtattttgggtgcgtccaatctctcatttaggggcaacgtcaatatttccgaggggcaaagtgcggatgtggttttcctgaatgccgacaacgggatgttggttcaggacttgccttttgaagtcaaactgaaaaaattccatatcgatttttacaatacgggtatgccgcgcgattttgccagcgatattgaagtaacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgagggatgcttcgcgcgaacctgtcgtgttgaaggcaacctccatacaccagtttccgttggaaatcggcaaacacaaatatcgtcttgagttcgatcagttcacttctatgaatgtggaggacatgagcgagggtgcggaacgggaaaaaagcctgaaatccactctgaacgatgtccgcgccgttactcaggaaggtaaaaaatacaccaatatcggcccttccatcgtgtaccgcatccgtgatgcggcagggcaggcggtcgaatataaaaactatatgctgccgattttgcaggacaaagattatttttggctgaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaagacgcacctgccgaaatccgcgaacaattcatgctggctgcggaaaacacgctgaatatctttgcgcaaaaaggctatttgggattggacgaatttattacgtccaatatcccgaaagggcagcaggataagatgcagggctatttctacgaaatgctttacggcgtgatgaacgctgctttggatgaaaccatacgccggtacggcttgcccgaatggcagcaggatgaagcgcggaaccgtttcctgctgcacagtatggatgcctatacggggctgacggaatatcccgcgcctatgctgctccagcttgacgggttttccgaggtgcgttcctcaggtttgcagatgacccgttcgccgggtgcgcttttggtctatctcggctcggtattgttggttttgggtacggtatttatgttttatgtgcgcgaaaaacgggcgtgggtattgttttcagacggcaaaatccgttttgctatgtcttcggcccgcagcgaacgggatttgcagaaggaatttccaaaacacgtcgagagcctgcaacggctcggcaaggacttgaatcatgactga

SEQ ID NO: 336 - protein, 671 aa, Neisseria gonorrhoeae; identical to SEQ ID NO: 330

SEQ ID NO: 337 - DNA, 489 bp, Neisseria meningitidis
atgatgagtaatamaatggmacaaaaagggtttacattgattgmgmtgatgatagtcgtcgcgatactcggcattatcagcgtcattgccataccttcttatcmaagttatattgaaaaaggctatcagtcccagctttatacggagatggycggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataa

SEQ ID NO: 338 - protein, 162 aa, Neisseria meningitidis
  misc_feature (5)..(5): Xaa= any amino acid
  misc_feature (7)..(7): Xaa= any amino acid
  misc_feature (15)..(16): Xaa= any amino acid
  misc_feature (35)..(35): Xaa= any amino acid
  misc_feature (51)..(51): Xaa= any amino acid
MMSNXMXQKGFTLIXXMIVVAILGIISVIAIPSYXSYIEKGYQSQLYTEMXGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 339 - DNA, 489 bp, Neisseria meningitidis
atgatgagtaataaaatggaacaaaaagggtttacattgattgagatgatgatagtcgtcgcgatactcggcattatcagcgtcattgccataccttcttatcaaagttatattgaaaaaggctatcagtcccagctttatacggagatggtcggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataa

SEQ ID NO: 340 - protein, 162 aa, Neisseria meningitidis
MMSNKMEQKGFTLIEMMIVVAILGIISVIAIPSYQSYIEKGYQSQLYTEMVGINNISKQFILKNPLDDNQTIENKLEIFVSGYKMNPKIAKKYSVSVKFVDKEKSRAYRLVGVPKAGTGYTLSVWMNSVGDGYKCRDAASAQAHLETLSSDVGCEAFSNRKK

SEQ ID NO: 341 - DNA, 489 bp, Neisseria meningitidis
  misc_feature (44)..(44): N= Unknown
  misc_feature (47)..(47): N= Unknown
  misc_feature (49)..(49): N= Unknown
  misc_feature (51)..(51): N= Unknown
  misc_feature (54)..(54): N= Unknown
  misc_feature (56)..(56): N= Unknown
  misc_feature (58)..(58): N= Unknown
  misc_feature (68)..(68): N= Unknown
  misc_feature (70)..(70): N= Unknown
  misc_feature (73)..(73): N= Unknown
  misc_feature (77)..(77): N= Unknown
  misc_feature (88)..(88): N= Unknown
  misc_feature (90)..(90): N= Unknown
  misc_feature (93)..(95): N= Unknown
  misc_feature (97)..(97): N= Unknown
  misc_feature (99)..(99): N= Unknown
  misc_feature (104)..(105): N= Unknown
  misc_feature (179)..(179): N= Unknown
  misc_feature (315)..(315): N= Unknown
atgatgagtaataaaatggaacaaaaagggtttacattgattgngangntnatngncntcgcgatacncngcnttancagcgtcattncnatnnntncntatcnnagttatattgaaaaaggctatcagtcccagctttatacggagatggtcggtatcaacaatatttccaaacagtntattttgaaaaatcccctggacgataatcagaccatcaagagcaaactggaaatatttgtctcaggctataagatgaatccgaaaattgccgaaaaatataatgtttcggtgcattttgtcaatgaggaaaaaccnagggcatacagcttggtcggcgttccaaagacggggacgggttatactttgtcggtatggatgaacagcgtgggcgacggatacaaatgccgtgatgccgcttctgcccgagcccatttggagaccttgtcctcagatgtcggctgtgaagccttctctaatcgtaaaaaatag

SEQ ID NO: 342 - protein, 162 aa, Neisseria meningitidis
  misc_feature (15)..(20): Xaa= any amino acid
  misc_feature (23)..(26): Xaa= any amino acid
  misc_feature (30)..(33): Xaa= any amino acid
  misc_feature (35)..(35): Xaa= any amino acid
  misc_feature (60)..(60): Xaa= any amino acid
MMSNKMEQKGFTLIXXXXXXAIXXXXSVIXXXXYXSYIEKGYQSQLYTEMVGINNISKQXILKNPLDDNQTIKSKLEIFVSGYKMNPKIAEKYNVSVHFVNEEKPRAYSLVGVPKTGTGYTLSVWMNSVGDGYKCRDAASARAHLETLSSDVGCEAFSNRKK

SEQ ID NO: 343 - DNA, 489 bp, Neisseria gonorrhoeae
atgatgagcaataaaatggaacaaaaagggtttacattgattgagatgatgatagttgtcacgatactcggcatcatcagcgtcattgccataccttcttatcagagttatattgaaaaaggctatcagtcccagctttatacggagatggtcggtatcaacaatgttctcaaacagtttattttgaaaaatccccaggacgataatgataccctcaagagcaaactgaaaatatttgtctcaggctataagatgaatccgaaaattgccaaaaaatatagtgtttcggtaaggtttgtcgatgcggaaaaaccaagggcatacaggttggtcggcgttccgaacgcggggacgggttatactttgtcggtatggatgaacagcgtgggcgacggatacaaatgccgtgatgccacttctgcccaggcctattcggacaccttgtccgcagatagcggctgtgaagctttctctaatcgtaaaaaatag

SEQ ID NO: 344 - protein, 162 aa, Neisseria gonorrhoeae
MMSNKMEQKGFTLIEMMIVVTILGIISVIAIPSYQSYIEKGYQSQLYTEMVGINNVLKQFILKNPQDDNDTLKSKLKIFVSGYKMNPKIAKKYSVSVRFVDAEKPRAYRLVGVPNAGTGYTLSVWMNSVGDGYKCRDATSAQAYSDTLSADSGCEAFSNRKK

SEQ ID NO: 345 - DNA, 276 bp, Neisseria meningitidis
  misc_feature (263)..(263): N= Unknown
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggsgcaccggtccgacggcaaaaacaagcgttggccnagaatttcaaccc

SEQ ID NO: 346 - protein, 93 aa, Neisseria meningitidis
  misc_feature (77)..(77): Xaa= any amino acid
  misc_feature (79)..(79): Xaa= any amino acid
  misc_feature (82)..(82): Xaa= any amino acid
  misc_feature (89)..(89): Xaa= any amino acid
MKKSSLISALGIGILSIGMAFAAPADAVSQIRQNATQVLSILKNGDANTARQKAEAYAIPYFDFQRMTALAVGNPWXTXSDXQKQALAXEFQP

SEQ ID NO: 347 - DNA, 591 bp, Neisseria meningitidis
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaagccaaaaacggcggcaaataa

SEQ ID NO: 348 - protein, 196 aa, Neisseria meningitidis
MKKSSLISALGIGILSIGMAFAAPADAVSQIRQNATQVLSILKNGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGGK

SEQ ID NO: 349 - DNA, 591 bp, Neisseria meningitidis
atgaaaaaatcctccttcatcagcgcattgggcatcggtattttgagcatcggcatggcatttgccgcccctgccgacgcggtaaaccaaatccgtcaaaacgccactcaagtattgagcatcttaaaaagcggtgatgccaacaccgcccgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaggctaaaaacggcagcaagtaa

SEQ ID NO: 350 - protein, 196 aa, Neisseria meningitidis
MKKSSFISALGIGILSIGMAFAAPADAVNQIRQNATQVLSILKSGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGSK

SEQ ID NO: 351 - DNA, 8 bp, Neisseria gonorrhoeae
  misc_feature (1)..(8): N= Unknown
nnnnnnnn

SEQ ID NO: 352 - protein, 196 aa, Neisseria gonorrhoeae
VKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 353 - DNA, 591 bp, Neisseria gonorrhoeae
atgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaataa

SEQ ID NO: 354 - protein, 196 aa, Neisseria gonorrhoeae
MKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 355 - DNA, 480 bp, Neisseria meningitidis
  misc_feature (138)..(162): N= Unknown
atgaaacacatactccccctgattgccgcatccgcactctgcatttcaaccgcttcggcacatcctgccagcgaaccgtccactcaaaacgaaaccgctatgatcacgcataccctcatctcaaaatacagttttggnnnnnnnnnnnnnnnnnnnnnnnnngccataaaaagcaaagggatggacatttttgccgtcatcgaccatcaggaagccgcacgccgaaacggcttaacgatgcagccggcaaaagtcatcgtcttcggcacgcccaaagccggcacgccgctgatggtcaaagaccccgccttcgccctgcaactgcccctacgcgtcctcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccgtaggcgaataa

SEQ ID NO: 356 - protein, 159 aa, Neisseria meningitidis
  misc_feature (47)..(54): Xaa= any amino acid
MKHILPLIAASALCISTASAHPASEPSTQNETAMITHTLISKYSFGXXXXXXXXAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 357 - DNA, 480 bp, Neisseria meningitidis
atgaaacacatactccccctgattgccgcatccgcactctgcatttcaaccgcttcggcacatcctgccagcgaaccgtccacccaaaacgaaaccgctatgaccacgcataccctcacctcaaaatacagttttgacgaaaccgtcagccgccttgaaaccgccataaaaagcaaagggatggacatttttgccgtcatcgaccatcaggaagccgcccgccgaaacggcttaacgatgcagccggcaaaagtcatcgtcttcggcacgcccaaagccggcacgccgctgatggtcaaagaccccgccttcgccctgcaactgcccctacgcgtcctcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccgtaggcgaataa

SEQ ID NO: 358 - protein, 159 aa, Neisseria meningitidis
MKHILPLIAASALCISTASAHPASEPSTQNETAMTTHTLTSKYSFDETVSRLETAIKSKGMDIFAVIDHQEAARRNGLTMQPAKVIVFGTPKAGTPLMVKDPAFALQLPLRVLVTETDGKVRAAYTDTRALIAGSRIGFDEVANTLANAEKLIQKTVGE

SEQ ID NO: 359 - DNA, 480 bp, Neisseria meningitidis
  misc_feature (5)..(5): N= Unknown
  misc_feature (23)..(23): N= Unknown
  misc_feature (26)..(26): N= Unknown
  misc_feature (59)..(60): N= Unknown
  misc_feature (337)..(337): N= Unknown
atganacacatactccccctgantgncgcatccgcactctgcatttcaaccgcttcggnncatcctgccagcgaaccgcaaacccaaaacgaaaccgctatgaccacgcataccctcacctcaaaatacagttttgacgaaaccgtcagccgccttgaaaccgccataaaaagcaaagggatggacatttttgccgtcatcgaccatcaggaagccgcccgccgaaacggcttaacgatgcagccggcaaaagtcatcgtcttcggcacgcccaaagccggtacgccgctgatggtcaaagaccccgccttcgccctgcaactgcccctgcgcgtcntcgttaccgaaacggacggcaaagtacgcgccgcctataccgatacgcgcgccctcatcgccggcagccgcatcggtttcgacgaagtggcaaacactttggcaaacgccgaaaaactgatacaaaaaaccataggcgaataa

SEQ ID NO: 360 - protein, 159 aa, Neisseria meningitidis
  misc_feature (2)..(2): Xaa= any amino acid
  misc_feature (8)..(9): Xaa= any amino acid
  misc_feature (20)..(20): Xaa= any amino acid
  misc_feature (113)..(113): Xaa= any amino acid
MXHILPLXXASALCISTASXHPASEPQTQNETAMTTHTLTSKYSFDETVSRLETAIKSKGMDIFAVIDHQEAARRNGLTMQPAKVIVFGTPKAGTPLMVKDPAFALQLPLRVXVTETDGKVRAAYTDTRALIAGSRIGFDEVANTLANAEKLIQKTIGE

SEQ ID NO: 361 - DNA, 8 bp, Neisseria gonorrhoeae
  misc_feature (1)..(8): N= Unknown
nnnnnnnn

SEQ ID NO: 362 - protein, 159 aa, Neisseria gonorrhoeae
MKHILPPIAASAFCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 363 - DNA, 480 bp, Neisseria gonorrhoeae
atgaaacacatactccccctgatcgccgcatccgcactctgcatttcaaccgcttcggcacaccctgccggcaaaccgcccacccaaaacgaaaccgctatgaccacgcacaccctcacctcgaaatacagttttgacgaaaccgtcagccgccttgaaaccgccataaaaagcaaagggatggacatttttgccgtcatcgaccatcaggaagcggcacgccgaaacggcctgaccatgcagccggcaaaagtcatcgtcttcggcacgcccaaggccggtacgccgctgatggtcaaagaccccgccttcgccctgcaactgcccctgcgcgtcctcgttaccgaaacggacggcaaagtacgcaccgcctataccgatacgcgcgccctcatcgtcggcagccgcatcagtttcgacgaagtggcaaacactttggcaaacgccgaaaaactgatacaaaaaaccgtaggcgaataa

SEQ ID NO: 364 - protein, 159 aa, Neisseria gonorrhoeae
MKHILPLIAASALCISTASAHPAGKPPTQNETAMTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 365 - DNA, 597 bp, Neisseria meningitidis
atggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaacgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 366 - protein, 198 aa, Neisseria meningitidis
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTKRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 367 - DNA, 597 bp, Neisseria meningitidis
atggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaccgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 368 - protein, 198 aa, Neisseria meningitidis
MAFITRLFKSSKWLIVPLMLPAFQNVAAEGIDVSRAEARITDGGQLSISSRFQTELPDQLQQALRRGVPLNFTLSWQLSAPIIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 369 - DNA, 600 bp, Neisseria meningitidis
  misc_feature (125)..(125): N= Unknown
  misc_feature (147)..(147): N= Unknown
  misc_feature (150)..(150): N= Unknown
  misc_feature (187)..(189): N= Unknown
  misc_feature (193)..(194): N= Unknown
  misc_feature (196)..(196): N= Unknown
  misc_feature (208)..(208): N= Unknown
  misc_feature (218)..(218): N= Unknown
  misc_feature (228)..(228): N= Unknown
  misc_feature (268)..(268): N= Unknown
  misc_feature (298)..(298): N= Unknown
  misc_feature (372)..(372): N= Unknown
atggcttttattacgcgcttattcaaaagcattaaacaatggcttgtgctgctgccgatgctttccgttttgccggacgcggcggcggaggggatagatgtgagccgcgccgaagcgaggataancgacggcgggcagctttccatnagnagccgcttccaaaccgagctgcccgaccagctccaannngcgnngngccggggcgtgncgctcaactntaccttaagntggcagctttccgccccgataatcgcttcttatcggtttnaattggggcaactgattggcgatgacgacnatattgactacaaactgagtttccatccgctgaccaaccgctaccgcgttaccgtcggcgcgttttcgacagantacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 370 - protein, 199 aa, Neisseria meningitidis
  misc_feature (42)..(42): Xaa= any amino acid
  misc_feature (49)..(50): Xaa= any amino acid
  misc_feature (63)..(63): Xaa= any amino acid
  misc_feature (65)..(66): Xaa= any amino acid
  misc_feature (70)..(70): Xaa= any amino acid
  misc_feature (73)..(73): Xaa= any amino acid
  misc_feature (76)..(76): Xaa= any amino acid
  misc_feature (90)..(90): Xaa= any amino acid
  misc_feature (100)..(100): Xaa= any amino acid
  misc_feature (124)..(124): Xaa= any amino acid
MAFITRLFKSIKQWLVLLPMLSVLPDAAAEGIDVSRAEARIXDGGQLSXXSRFQTELPDQLQXAXXRGVXLNXTLXWQLSAPIIASYRFXLGQLIGDDDXIDYKLSFHPLTNRYRVTVGAFSTXYDTLDAALRATGAVANWKVLNKGALSGAEAGETKAEIRLTLSTSKLPKPFQINALTSQNWHLDSGWKPLNIIGNK

SEQ ID NO: 371 - DNA, 600 bp, Neisseria gonorrhoeae
atggcttttattacgcgcttattcaaaagcattaaacaatggcttgtgctgttgccgatactctccgttttgccggacgcggcggcggagggcattgccgcgacccgcgccgaagcgaggataaccgacggcgggcggctttccatcagcagccgcttccaaaccgagctgcccgaccagctccaacaggcgttgcgccggggcgtaccgctcaactttaccttaagctggcagctttccgccccgacaatcgcttcttatcggtttaaattggggcaactgattggcgatgacgacaatattgactacaaactaagtttccatccgctgaccaaccgctaccgcgttaccgtcggcgcattttccaccgattacgacactttggatgcggcattgcgcgcgaccggcgcggttgccaactggaaagtcctgaacaaaggcgcgttgtccggtgcggaagcaggggaaaccaaggcggaaatccgcctgacgctgtccacttcaaaactgcccaagcctttccaaatcaacgcattgacttctcaaaactggcatttggattcgggttggaaacctctaaacatcatcgggaacaaataa

SEQ ID NO: 372 - protein, 199 aa, Neisseria gonorrhoeae
MAFITRLFKSIKQWLVLLPILSVLPDAAAEGIAATRAEARITDGGRLSISSRFQTELPDQLQQALRRGVPLNFTLSWQLSAPTIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 373 - DNA, 1419 bp, Neisseria meningitidis
atggacacaaaagaaatcctcggtacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgtgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggtgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgctcgcctctcggcaacggcagaatccgccgccgccctgcttgcctccgccctctgctgaccggcattttctcgccccttgcctccctcctgctgccggaaaactacgccgccgtccggtttatcgtcgtatcgtgtatgtgccgccgctgttttgcacgctggcggaaatcagcggcatcggtttgaacgtcgttcgcaaaacgcgcccgatcgcgctcgccaccttgggcgcgctggcggcaaacctgctgctgctggggcttgaccgtgccgtaccggcgaggccgccggcgcggcggttgcctgtgccgcctcattctggctgttttttgccttcaagaccgaaagctcytgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 374 - protein, 474 aa, Neisseria meningitidis
  misc_feature (8)..(8): Xaa= any amino acid
  misc_feature (157)..(157): Xaa= any amino acid
  misc_feature (213)..(213): Xaa= any amino acid
  misc_feature (304)..(304): Xaa= any amino acid
  misc_feature (332)..(332): Xaa= any amino acid
  misc_feature (382)..(382): Xaa= any amino acid
MDTKEILXYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLXPLTVGLLHFPANTAVLTAVYALANLAAAAFLLFQNRCRLKAVRHAPFSPAVLHRGXRYGIPIALSSIAYWGLASADRLFLKKYAGLEQLGVYSMGISFGGAALLFQSIFSTVWTPYIFRAIEENAPPARLSATAESAAALLASALCXTGIFSPLASLLLPENYAAVRFIVVSCMXPPLFCTLAEISGIGLNVVRKTRPIALATLGALAANLLLLGLDRAVPARPXGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 375 - DNA, 1422 bp, Neisseria meningitidis
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 376 - protein, 473 aa, Neisseria meningitidis
MDTKEILGYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLLPLTVGLLHFPANTAVLTAVYALANLAAAAFLLFQNRCRLKAVRHAPFSPAVLHRGLRYGIPIALSSIAYWGLASADRLFLKKYAGLEQLGVYSMGISFGGAALLFQSIFSTVWTPYIFRAIEENAPPARLSATAESAAALLASALCLTGIFSPLASLLLPENYAAVRFIVVSCMLPPLFCTLAEISGIGLNVVRKTRPIALATLGALAANLLLLGLAVPSGGARGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 377 - DNA, 1422 bp, Neisseria meningitidis
atggacacaaaagaaatcctcggctacgcggcaggctcgatcggcagcgcggttttagccgtcatcatcctgccgctgctgtcgtggtatttccctgccgacgacatcggacgcatcgtgctgatgcagacggcggcggggctgacggtgtcggtgttgtgcctcgggctggatcaggcatacgtccgcgaatactatgccgccgccgacaaagacactttgttcaaaaccctgttcctgccgccgctgctgtctgccgccgcgatagccgccctgctgctttcccgcccatccctgccgtctgaaatcctgttttcgctcgacgatgccgccgccggcatcgggctggtgctgtttgaactgagcttcctgcccatccgctttctcttactggttttgcgtatggaaggacgcgcccttgccttttcgtccgcgcaactcgtgtccaagctcgccatcctgctgctgctgccgctgacggtcgggctgctgcactttccggcgaacaccgccgtcctgaccgccgtttacgcgctggcaaaccttgccgccgccgcctttttgctgtttcaaaaccgatgccgtctgaaggccgtccggcgcgcaccgttttcatccgccgtcctgcatcgcggcctgcgctacggcataccgatcgcactaagcagcatcgcctattgggggctggcatccgccgaccgtttgttcctgaaaaaatatgccggcctagaacagctcggcgtttattcgatgggtatttcgttcggcggagcggcattattgttccaaagcatcttttcaacggtctggacaccgtatattttccgcgcaatcgaagcaaacgccccgcccgcccgcctctcggcaacggcagaatccgccgccgccctgcttgcctccgccctctgcctgaccggcattttctcgcccctcgcctccctcctgctgccggaaaactacgccgccgtccggtttatcgtcgtatcgtgtatgctgcctccgctgttttgcacgctggtagaaatcagcggcatcggtttgaacgtcgtccgaaaaacacgcccgatcgcgctcgccaccttgggcgcgctggcggcaaacctgctgctgctggggcttgccgtaccgtccggcggcgcgcgcggcgcggcggttgcctgtgccgcctcattttggctgttttttgttttcaagaccgaaagctcctgccgcctgtggcagccgctcaaacgcctgccgctttatatgcacacattgttctgcctggcctcctcggcggcctacacctgcttcggcactccggcaaactaccccctgtttgccggcgtatgggcggtatatctggcaggctgcatcctgcgccaccggaaagatttgcacaaactgtttcattatttgaaaaaacaaggtttcccattatga

SEQ ID NO: 378 - protein, 473 aa, Neisseria meningitidis
MDTKEILGYAAGSIGSAVLAVIILPLLSWYFPADDIGRIVLMQTAAGLTVSVLCLGLDQAYVREYYAAADKDTLFKTLFLPPLLSAAAIAALLLSRPSLPSEILFSLDDAAAGIGLVLFELSFLPIRFLLLVLRMEGRALAFSSAQLVSKLAILLLLPLTVGLLHFPANTAVLTAVYALANLAAAAFLLFQNRCRLKAVRRAPFSSAVLHRGLRYGIPIALSSIAYWGLASADRLFLKKYAGLEQLGVYSMGISFGGAALLFQSIFSTVWTPYIFRAIEANAPPARLSATAESAAALLASALCLTGIFSPLASLLLPENYAAVRFIVVSCMLPPLFCTLVEISGIGLNVVRKTRPIALATLGALAANLLLLGLAVPSGGARGAAVACAASFWLFFVFKTESSCRLWQPLKRLPLYMHTLFCLASSAAYTCFGTPANYPLFAGVWAVYLAGCILRHRKDLHKLFHYLKKQGFPL

SEQ ID NO: 379 - DNA, 1422 bp, Neisseria gonorrhoeae
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcgggactgacggtgtcggtattgtgcctcgggctggatcaggcatacgtccgcgaatactatgccgccgccgacaaagacactttgttcaaaaccctgttcctgccgccgctgctgttttccgccgcgatagccgccctgctgctttcccgcccgtccctgccgtctgaaatcctgttttcgctcgacgatgccgccgccggcatcgggctggtgctgtttgaactgagcttcctgcccatccgctttctcttactggttttgcgtatggaagggcgcgcccttgccttttcgtccgcgcaactcgtgcccaaactcgccattctgctgctgttgccgctgacggtcgggctgctgcactttccggcgaacacctccgtcctgaccgccgtttacgcgctggcaaaccttgccgccgccgcctttttgctgtttcaaaaccgatgccgtctgaaggccgtccggcgcgcgccgttttcgcccgccgtcctgcaccgggggctgcgctacggcataccgctcgcactgagcagccttgcctattgggggctggcatccgccgaccgtttgttcctgaaaaaatatgcgggcctggaacagctcggcgtttattcgatgggtatttcgttcggcggggcggcattattgctccaaagcatcttttcaacggtctggacaccgtatattttccgtgcaatcgaagaaaacgccacgcccgcccgcctctcggcaacggcagaatccgccgccgccctgcttgcctccgccctctgcctgaccggaattttctcgcccctcgcctccctcctgctgccggaaaactacgccgccgtccggtttaccgtcgtatcgtgtatgctgccgccgctgttttacacgctgaccgaaatcagcggcatcggtttgaacgtcgtccgcaaaacgcgtccgatcgcgcttgccaccttgggcgcgctggcggcaaacctgctgctgctggggcttgccgtaccgtccggcggcacgcgcggcgcggcggttgcctgtgccgcctcattctggttgttttttgttttcaagacagaaagctcctgccgcctgtggcagccgctcaaacgcctgccgctttatatgcacacattgttctgcctggcctcctcggcggcctacacctgcttcggcacaccggcaaactaccccctgtttgccggcgtatgggcggcatatctggcaggctgcatcctgcgccaccggaaaaatttgcacaaactgtttcattatttgaaaaaacaaggtttcccattatga

SEQ ID NO: 380 - protein, 473 aa, Neisseria gonorrhoeae
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 381 - DNA, 637 bp, Neisseria meningitidis
atcctgaaaccgcataaccagcttaaggaagacatccaacctgatccggccgatcaaaacgccttgtccgaaccggatgctgcgacagaggcagagcagtcggatgcggaaaatgctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaatacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaamgcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 382 - protein, 212 aa, Neisseria meningitidis
  misc_feature (138)..(138): Xaa= any amino acid
  misc_feature (151)..(151): Xaa= any amino acid
  misc_feature (159)..(159): Xaa= any amino acid
ILKPHNQLKEDIQPDPADQNALSEPDAATEAEQSDAENAADKQPVADKADEVEEKAGEPEREEPDGQAVRKKALTEEREQTVREKAQKKDAETVKIQAVKPSKETEKKASKEEKKAAKEKVAPKPTPEQILNSGSIEXARSAAAKEVQKMXNVRQGGSXRIICKWARMPTVRARKGSVPNWQSWAYLPRWSVIRRDIKRFTGCKAAICLPMR

SEQ ID NO: 383 - DNA, 870 bp, Neisseria meningitidis
atgtttatgaacaaattttcccaatccggaaaaggtctgtccggttttttcttcggtttgatactggcgacggtcattattgccggtattttgttttatctgaaccagagcggtcaaaatgcgttcaaaatcccggcttcgtcgaagcagcctgcagaaacggaaatcctgaaaccgaaaaaccagcctaaggaagacatccaacctgaaccggccgatcaaaacgccttgtccgaaccggatgctgcgacagaggcagagcagtcggatgcggaaaaagctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataa

SEQ ID NO: 384 - protein, 289 aa, Neisseria meningitidis
MFMNKFSQSGKGLSGFFFGLILATVIIAGILFYLNQSGQNAFKIPASSKQPAETEILKPKNQPKEDIQPEPADQNALSEPDAATEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSGSIEKARSAAAKEVQKMKTSDKAEATHYLQMGAYADRQSAEGQRAKLAILGISSKVVGYQAGHKTLYRVQSGNMSADAVKKMQDELKKHEVASLIRSIESK

SEQ ID NO: 385 - DNA, 770 bp, Neisseria meningitidis
tgaaccagagcggtcaaaatgcgttcaaaatcccggttccgtcgaagcagcctgcagaaacggaaatcctgaaaccgaaaaaccagcctaaggaagacatccaacctgaaccggccgatcaaaacgccttgtccgaaccggatgctgcgaaagaggcagagcagtcggatgcggaaaaagctgccgacaagcagcccgttgccgacaaagccgacgaggttgaggaaaaggcggacgagccggagcgggaaaagtcggacggacaggcagtgcgcaagaaagcactgacggaagagcgtgaacaaaccgtcggggaaaaagcgcagaagaaagatgccgaaacggttaaaaaacaagcggtaaaaccatctaaagaaacagagaaaaaagcttcaaaagaagagaaaaaggcggagaaggaaaaagttgcacccaaaccgaccccggaacaaatcctcaacagcggcagcatcgaaaaagcgcgcagtgccgctgccaaagaagtgcagaaaatgaaaacgcccgacaaggcggaagcaacgcattatctgcaaatgggcgcgtatgccgaccgccggagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataa

SEQ ID NO: 386 - protein, 289 aa, Neisseria meningitidis
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPDKAEATHYLQMGAYADRRSAEGQRAKLAILGISSKVVGYQAGHKTLYRVQSGNMSADAVKKMQDELKKHEVASLIRSIESK

SEQ ID NO: 387 - DNA, 8 bp, Neisseria gonorrhoeae
  misc_feature (1)..(8): N= Unknown
nnnnnnnn

SEQ ID NO: 388 - protein, 267 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKKAVKPSKETEKKASKEEKKAAKEKVAPKPTPEQILNSRSIEKARSAAAKEVQKMKNFGQGGSQRIICKWARMPNPGARKGSVPNWQSWAYLPKWSAIRRDIKRFTACKAAICPPMR

SEQ ID NO: 389 - DNA, 873 bp, Neisseria gonorrhoeae
atgtttatgaacaaattttcccaatccggaaaaggtctgtccggtttcttcttcggtttgatactggcaacggtcattattgccggtattttgctttatctgaaccagggcggtcaaaatgcgttcaaaatcccggctccgtcgaagcagcctgcagaaacggaaatcctgaaactgaaaaaccagcctaaggaagacatccaacctgaaccggccgatcaaaacgccttgtccgaaccggatgttgcgaaagaggcagagcagtcggatgcggaaaaagctgccgacaagcagcccgttgccgacaaagccgacgaggttgaagaaaaggcgggcgagccggaacgggaagagccggacggacaggcagtgcgcaagaaagcactgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaagaaaaagttgcacccaaaccgaccccggaacaaatcctcaacagccgcagcatcgaaaaagcgcgtagtgccgctgccaaagaagtgcagaaaatgaaaaactttgggcaaggcggaagccaacgcattatctgcaaatgggcgcgtatgccgaccgtccggagcgcggaagggcagcgtgccaaactggcaatcttgggcatatcttccgaagtggtcggctatcaggcgggacataaaacgctttaccgcgtgcaaagcggcaatatgtccgccgatgcggtgaaaaaaatgcaggacgagttgaaaaagcatggggttgccagcctgatccgtgcgattgaaggcaaataa

SEQ ID NO: 390 - protein, 290 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSRSIEKARSAAAKEVQKMKNFGQGGSQRIICKWARMPTVRSAEGQRAKLAILGISSEVVGYQAGHKTLYRVQSGNMSADAVKKMQDELKKHGVASLIRAIEGK

SEQ ID NO: 391 - DNA, 668 bp, Neisseria meningitidis
atgaaccacgacatcactttcctcaccctgttcctactcggtktcttcggcggaacgcactgcatcggtatgtgcggcggattaagcagcgcgtttgsstccaactccccccgcatatcaaccgcttttggctgatcctgctgcttaacacaggacgggtaagcagctatacggcaatcggcctgatactcggattaatcggacaggtcggcgtttcactcgaccaaacccgcgtcctgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactggtttacagcgcgtcgctttacgcgctgggaagcggtagtgcggcaacgggcgggttatatatgcttgcctttgcactgggtacgctgcccaatcttttagcaatcggcattttttccctgcaactgaawaaaatcatgcaaaaccgatatatccgcctgtgtacgggattatccgtatcattatgggcattatggaaacttgccgtcctgtggctgtaa

SEQ ID NO: 392 - protein, 222 aa, Neisseria meningitidis
  misc_feature (15)..(15): Xaa= any amino acid
  misc_feature (33)..(34): Xaa= any amino acid
  misc_feature (193)..(193): Xaa= any amino acid
MNHDITFLTLFLLGXFGGTHCIGMCGGLSSAFXXQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLXKIMQNRYIRLCTGLSVSLWALWKLAVLWL

SEQ ID NO: 393 - DNA, 669 bp, Neisseria meningitidis
atgaaccacgacatcactttcctcaccctgttcctactcggtttcttcggcggaacgcactgcatcggtatgtgcggcggattaagcagcgcgtttgcgctccaactccccccgcatatcaaccgcttttggctgatcctgctgcttaacacaggacgggtaagcagctatacggcaatcggcctgatactcggattaatcggacaggtcggcgtttcactcgaccaaacccgcgtcctgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactggtttacagcgcgtcgctttacgcgctgggaagcggtagtgcggcaacgggcgggttatatatgcttgcctttgcactgggtacgctgcccaatcttttagcaatcggcattttttccctgcaactgaaaaaaatcatgcaaaaccgatatatccgcctgtgtacgggattatccgtatcattatgggcattatggaaacttgccgtcctgtggctgtaa

SEQ ID NO: 394 - protein, 222 aa, Neisseria meningitidis
MNHDITFLTLFLLGFFGGTHCIGMCGGLSSAFALQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLKKIMQNRYIRLCTGLSVSLWALWKLAVLWL

SEQ ID NO: 395 - DNA, 669 bp, Neisseria meningitidis
  misc_feature (9)..(9): N= Unknown
  misc_feature (129)..(129): N= Unknown
  misc_feature (238)..(238): N= Unknown
  misc_feature (548)..(548): N= Unknown
  misc_feature (577)..(577): N= Unknown
atgaaccangacatcactttcctcaccctgttcctactcggtttcttcggcggaacgcactgcatcggtatgtgcggcggattaagcagcgcgtttgcgctccaactccccccgcatatcaaccgcttntggctgatcctgctgcttaacacaggacgggtaagcagctatacggcaatcggcctgatactcggattaatcggacaggtcggcgtttcactcgaccaaacccgcgtcntgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactagtttacagcgcgtcgctttacgcgctgggaagcggtagtgcggcaacgggcgggttatatatgcttgcctttgcactgggtacgctgcccaatctttnggcaatcggcattttttccctgcaactgnaaaaaatcatgcaaaaccgatatatccgcctgtgtacgggattatccgtatcattatgggcattatggaaacttgccgtcctgtggctgtaa

SEQ ID NO: 396 - protein, 222 aa, Neisseria meningitidis
  misc_feature (3)..(3): Xaa= any amino acid
  misc_feature (43)..(43): Xaa= any amino acid
  misc_feature (80)..(80): Xaa= any amino acid
  misc_feature (183)..(183): Xaa= any amino acid
  misc_feature (193)..(193): Xaa= any amino acid
MNXDITFLTLFLLGFFGGTHCIGMCGGLSSAFALQLPPHINRXWLILLLNTGRVSSYTAIGLILGLIGQVGVSLDQTRVXQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLXAIGIFSLQLXKIMQNRYIRLCTGLSVSLWALWKLAVLWL

SEQ ID NO: 397 - DNA, 669 bp, Neisseria gonorrhoeae
atgaaccacgacatcactttcctcaccctgttcctgctcggtttcttcggcggaactcactgcatcggtatgtgcggcggattaagcagcgcgtttgcgctccaactccccccgcatatcaaccgcttttggctgattctgctgcttaacacaggacggataagcagctatacggcaatcggcctgatgctcggattaatcggacaactcggcatttcactcgaccaaacccgcgtcctgcaaaatattttatacacagcctccaacctcctgctgctctttttaggcttatacttgagcggtatttcttccttggcggcaaaaatcgagaaaatcggcaaaccgatatggcgcaacctgaacccgatactcaaccggctgctgcccataaaatccatacccgcctgccttgctgtcggaatattatggggctggctgccgtgcggactggtttacagcgcatcactttacgcgctgggaagcggtagtgcgacaaccggcggactgtatatgcttgcctttgcactgggtacgctgcccaatcttttggcaatcggcattttttccctgcaactgaaaaaaatcatgcaaaaccgatatatccgcctgtgtacaggattatccgtatcattatgggcattatggaagcttgccgtcctgtggctgtaa

SEQ ID NO: 398 - protein, 222 aa, Neisseria gonorrhoeae
MNHDITFLTLFLLGFFGGTHCIGMCGGLSSAFALQLPPHINRFWLILLLNTGRISSYTAIGLMLGLIGQLGISLDQTRVLQNILYTASNLLLLFLGLYLSGISSLAAKIEKIGKPIWRNLNPILNRLLPIKSIPACLAVGILWGWLPCGLVYSASLYALGSGSATTGGLYMLAFALGTLPNLLAIGIFSLQLKKIMQNRYIRLCTGLSVSLWALWKLAVLWL

SEQ ID NO: 399 - DNA, 832 bp, Neisseria meningitidis
atggaaaaccaaaggccgctcctaggctttcgcttggcacttttggcggcgatgacgtggggaacgctgccgattccgtgcggcaggtattgaagtttgtcgatgcgccgacgctggtgtgggtgcgttttaccgtggcggcggcggtattgtttgttttgctggcactgggcgggcggctgccgaagcggcgaggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgtwgtcggtgtgttggtgtttaaagaccggatgactgccgctcagaaaatcggcttggttttgctgcttgccggtttgcttatgtattttaacgataaattcggcgagttgtcgggtttgggcgcgtatgcaagggcgtgttgctgtgtgcggcaggcagtatggcatgggtgtgtaatgccgtggcgcaaaagctgctgtcggcgcaattcgggccgcaacagattctgctgttgatttatgcggcaagtgccgccgtgttcctgccgtttgccgaaccggcacacatcggaagtatggacggtacgttggcgtgggtatgtattgcgtattgctgcttgaatacgttaatcggttacggctcgttcggcgaggcgttgaaacattgggaggcttccaaagtcagcgcggtaacaaccttgctccccgtgtttaccgtaataaatactttgctcgggcattatgtgatgcctgaaacttttgccgcgccgga

SEQ ID NO: 400 - protein, 277 aa, Neisseria meningitidis
  misc_feature (25)..(25): Xaa= any amino acid
  misc_feature (157)..(157): Xaa= any amino acid
MENQRPLLGFRLALLAAMTWGTLPXSVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMYFNDKFGELSGLGAYXKGVLLCAAGSMAWVCNAVAQKLLSAQFGPQQILLLIYAASAAVFLPFAEPAHIGSMDGTLAWVCIAYCCLNTLIGYGSFGEALKHWEASKVSAVTTLLPVFTVINTLLGHYVMPETFAAP

SEQ ID NO: 401 - DNA, 833 bp, Neisseria meningitidis
atggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcactgggcgggcggctgccgaagcggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatawtwwctttgctcgggcattatgtgatgcctgaaacttttgccgcgccgga

SEQ ID NO: 402 - protein, 277 aa, Neisseria meningitidis
  misc_feature (262)..(263): Xaa= any amino acid
MENQRPLLGFALALLAAMTWGTLPIAVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAEPAHIGSLDGTLAWVCFAYCCLNTLIGYGSFGEALKHWEASKVSAVTTLLPVFTVIXXLLGHYVMPETFAAP

SEQ ID NO: 403 - DNA, 924 bp, Neisseria meningitidis
atggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcattgggcgggcggctgccgaagtggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaactggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgccggcgcactggtcgtggtcgggggtgcggttacggcggcggtgggggacaggctgttcaaacgccgctag

SEQ ID NO: 404 - protein, 307 aa, Neisseria meningitidis
MENQRPLLGFALALLAAMTWGTLPIAVRQVLKFVDAPTLVWVRFTVAAAVLFVLLALGGRLPKWRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAELAHIGSLDGTLAWVCFAYCCLNTLIGYGSFGEALKHWEASKVSAVTTLLPVFTVIFSLLGHYVMPDTFAAPDMNGLGYAGALVVVGGAVTAAVGDRLFKRR

SEQ ID NO: 405 - DNA, 8 bp, Neisseria gonorrhoeae
  misc_feature (1)..(8): N= Unknown
nnnnnnnn

SEQ ID NO: 406 - protein, 307 aa, Neisseria gonorrhoeae
  misc_feature (204)..(204): Xaa= any amino acid
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLLXAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 407 - DNA, 924 bp, Neisseria gonorrhoeae
atggaaaaccaaaggccgctcctaggcttcgcgttggcacttttggcggcgatgacgtgggggacgctgccgattgccgtgcggcaggtattgaagtttgtcgatgcgccgacgctggtgtgggtgcgttttaccgtggcggcggcggtattgtttgttttgctggcattgggcgggcggctgccgaagcggcgggatttttcttggcattcattcaggctgctgctgctcggcgtgacgggcatttcggcaaactttgtgctgattgcccaagggctgcattatatttcgccgaccacgacgcaggttttgtggcagatttcgccgtttacgatgattgttgtcggcgtgttggtgtttaaagaccggatgactgccgcgcagaaaatcggtttggttttgctgcttgtcggtttgcttatgttttttaacgacaaattcggcgagttgtcgggtttgggcgcgtatgcgaagggcgtgttgctgtgtgcggcaggcagtatggcctgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgtgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgtcggcgcactggtcgtggtcgggggtgcggttacggcggcggtgggggacaggccgttcaaacgccgctag

SEQ ID NO: 408 - protein, 307 aa, Neisseria gonorrhoeae
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLPFAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 409 - DNA, 933 bp, Neisseria meningitidis
atggtagctcgtcgggctcataacccgaaggtcgtaggttcgaatcctgtcccgcaacctaatttcaaacccctcggttcaatgccgaggggttttgttttgcctgtttcctgtttcctgtttcctgccgcctccgttttttgccggattttccttccggccgcaatatcggaacggcagaccgccgtctgtttgcggttgcaaattcaggcagtttggctacaatcttccgcattgtcttcaagaaagccaaccatgccgaccgtccgttttaccgaatccgtcagcaaacaagaccttgatgctctgttcgagtgggcaaaagcaagttacggtgcagaaagttgctggaaaacgctgtatctgaacggtcyscctttgggcaacctgtcgccggaatgggtggaacgcgtsmmaaaagactgggaggcaggctgcycggagtcttcagacggcatttttctgaatgcggacggctggcctgatatgggcggacgcttacagcacctcgccctcggttggcactgtgcggggctgttggacggstggcgcaacgagtgtttcgacctgaccgacggcggcggcaaccccttgttcacgctcgaacgcgccgytttmcgtcctktcggactgctcagccgcgccgtccatctcaacggtctgaccgaatcggacggccgatggcatttctggataggcaggcgcagtccgcacaaagcagtcgatcccaacaaactcgacaatactrccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgccg

SEQ ID NO: 410 - protein, 312 aa, Neisseria meningitidis
  misc_feature (17)..(17): Xaa= any amino acid
  misc_feature (21)..(21): Xaa= any amino acid
  misc_feature (31)..(31): Xaa= any amino acid
  misc_feature (34)..(34): Xaa= any amino acid
  misc_feature (126)..(126): Xaa= any amino acid
  misc_feature (140)..(140): Xaa= any amino acid
  misc_feature (148)..(148): Xaa= any amino acid
  misc_feature (206)..(207): Xaa= any amino acid
  misc_feature (210)..(210): Xaa= any amino acid
  misc_feature (251)..(251): Xaa= any amino acid
MVARRAHNPKVVGSNPXPATXFQTPRFNAEXVLXLPVSCFLFPAASVFCRIFLPAAISERQTAVCLRLQIQAVWLQSSALSSRKPTMPTVRFTESVSKQDLDALFEWAKASYGAESCWKTLYLNGXPLGNLSPEWVERVXKDWEAGCXESSDGIFLNADGWPDMGGRLQHLALGWHCAGLLDGWRNECFDLTDGGGNPLFTLERAXXRPXGLLSRAVHLNGLTESDGRWHFWIGRRSPHKAVDPNKLDNTXAGGVSGGEMPSEAVCRESSEEAGLDKTLLPLIRPVSQLHSLRSVSRGVHNEILYVFDAVLP

SEQ ID NO: 411 - DNA, 876 bp, Neisseria meningitidis
atgccgaccgtccgttttaccgaatccgtcagcaaacaagaccttgatgctctgttcgagtgggcaaaagcaagttacggtgcagaaagttgctggaaaacgctgtatctgaacggtctgcctttgggcaacctgtcgccggaatgggtggaacgcgtcaaaaaagactgggaggcaggctgctcggagtcttcagacggcatttttctgaatgcggacggctggcctgatatgggcggacgcttacagcacctcgccctcggttggcactgtgcggggctgttggacggctggcgcaacgagtgtttcgacctgaccgacggcggcggcaaccccttgttcacgctcgaacgcgccgctttccgtcctttcggactgctcagccgcgccgtccatctcaacggtctgaccgaatcggacggccgatggcatttctggataggcaggcgcagtccgcacaaagcagtcgatcccaacaaactcgacaatactgccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgcccgaaaccttcctgcctgaaaatcaggatggcgaagtggcgggttttgagaaaatggacatcggcggtctgttggatgccatgttgtcgggaaacatgatgcacgacgcgcaactggttacgctggacgcgttttgccgttacggtctgattgatgccgcccatccgctgtccgagtggctggacggcatacgtttatag

SEQ ID NO: 412 - protein, 291 aa, Neisseria meningitidis
MPTVRFTESVSKQDLDALFEWAKASYGAESCWKTLYLNGLPLGNLSPEWVERVKKDWEAGCSESSDGIFLNADGWPDMGGRLQHLALGWHCAGLLDGWRNECFDLTDGGGNPLFTLERAAFRPFGLLSRAVHLNGLTESDGRWHFWIGRRSPHKAVDPNKLDNTAAGGVSGGEMPSEAVCRESSEEAGLDKTLLPLIRPVSQLHSLRSVSRGVHNEILYVFDAVLPETFLPENQDGEVAGFEKMDIGGLLDAMLSGNMMHDAQLVTLDAFCRYGLIDAAHPLSEWLDGIRL

SEQ ID NO: 413 - DNA, 876 bp, Neisseria meningitidis
atgccgaccgtccgttttaccgaatccgtcagcaaacacgaccttgatgccctattcgagtgggcaaaggcaagttacggtgcggaaagttgctggaaaacgctgtatctgaacggtctgcctttgggcaatctgtcgccggaatgggcggagcgcgtcaaaaaagactgggaggcaggctgctcggagtcttcagacggcattttcctgaatgcggacggctggccagatatgggcagacgcttgcagcacctcgcccgaatatggaaagaagcgggactgcttcacggctggcgcgacgagtgtttcgacctgaccgacggcggcagcaatcccttgttcgcgctcgaacgcgccgctttccgtccgttcggactgctcagccgcgccgtccatctcaacggtttggtcgaatcggacggccgatggcatttctggataggcaggcgcagtccgcacaaagcagtcgatcccgacaaactcgacaatactgccgccggcggtgtttccagcggtgaattgccgtctgaaaccgtgtgtcgcgaaagcagcgaagaagccggtttggataaaacgctgcttccgctcatccgcccggtatcgcagctgcacagcctgcgccccgtcagccggggtgtgcacaatgaaatcctgtatgtattcgatgccgtcctgcccgaaaccttcctgcctgaaaatcaggatggcgaagtggcgggttttgagaaaatggacatcggcggtctgttggctgccatgttgtcgggaaacatgatgcacgacgcgcaactggttacgctggacgcgttttgccgttacggtctgattgatgccgcccatccgctgtccgagtggctggacggcatacgtttatag

SEQ ID NO: 414 - protein, 291 aa, Neisseria meningitidis
MPTVRFTESVSKHDLDALFEWAKASYGAESCWKTLYLNGLPLGNLSPEWAERVKKDWEAGCSESSDGIFLNADGWPDMGRRLQHLARIWKEAGLLHGWRDECFDLTDGGSNPLFALERAAFRPFGLLSRAVHLNGLVESDGRWHFWIGRRSPHKAVDPDKLDNTAAGGVSSGELPSETVCRESSEEAGLDKTLLPLIRPVSQLHSLRPVSRGVHNEILYVFDAVLPETFLPENQDGEVAGFEKMDIGGLLAAMLSGNMMHDAQLVTLDAFCRYGLIDAAHPLSEWLDGIRL

SEQ ID NO: 415 - DNA, 8 bp, Neillia sinensis
  misc_feature (1)..(8): N= Unknown
nnnnnnnn

SEQ ID NO: 416 - protein, 372 aa, Neisseria gonorrhoeae
MVARRAHNPKVVGSNPAPATKYQTPRFNAEGVLFFLFPAASVFCRIFLPAAISERQAAVCLRLQIQAVWLQSSALCSRKPAMPTVRFTESVSKQDLDALFERAKASYGAESCWKTLYLNRLPLGNLSPEWAERIKKDWEAGCSESSNGIFLNADGWPDMGGRLQHLARTWNKAGLLHGWRNECFDLTDGGGNPLFTLERAAFRPFGLLIRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 417 - DNA, 876 bp, Neisseria gonorrhoeae
atgccgaccgtccgttttaccgaatccgtcagcaaacaagaccttgatgccctgttcgagcgggcaaaagcaagttacggtgccgaaagttgctggaaaacgctgtatctgaaccgtcttcctttgggcaatctgtcgccggaatgggctgagcgcatcaaaaaagactgggaggcaggctgctccgagtcttcagacggcatttttctgaatgcggacggctggccggatatgggcggacgcttgcagcacctcgcccgcacatggaacaaggcggggctgcttcacggatggcgcaacgagtgtttcgacctgaccgacggcggcggcaaccccttgttcacgctcgaacgcgccgctttccgtccgttcggactactcagccgcgccgtccatctcaacggtttggtcgaatcgaacggcagatggcatttttggataggcaggcgcagtccgcacaaagcagtcgatcccggcaagctcgacaatattgccggcggcggtgtttccggcggcgaaatgccgtctgaagccgtgtgccgcgaaagcagcgaagaagccggtttggataaaacgctgtttccgctcatccgcccagtatcgcggctgcacagccttcgccccgtcagccgaggtgtgcacaatgaaatcctgtatgtgttcgatgccgtcctgcccgaaaccttcctgcctgaaaatcaggatggcgaggtagcgggttttgaaaagatggacattggcggcctattggatgccatgttgtcgaaaaacatgatgcacgacgcgcaactggttacgctggacgcgttttaccgttacggtctgattgatgccgcccatccgctgtccgagtggctggacggcatacgtttatag

SEQ ID NO: 418 - protein, 291 aa, Neisseria gonorrhoeae
MPTVRFTESVSKQDLDALFERAKASYGAESCWKTLYLNRLPLGNLSPEWAERIKKDWEAGCSESSDGIFLNADGWPDMGGRLQHLARTWNKAGLLHGWRNECFDLTDGGGNPLFTLERAAFRPFGLLSRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 419 - DNA, 566 bp, Neisseria meningitidis
atgaatagacccaagcaacccttcttccgtcccgaagtcgccgttgcccgccaaaccagcctgacgggtaaagtgattctgacacgaccgttgtcattttccctatggacgacatttgcatcgatatctgcgttattgattatcctgtttttgatatttggtaactatacgcgaaagacaacagtggagggacaaattttacctgcatcgggcgtaatcagggtgtatgcaccggatacgrgkacaattacagcgaaattcgtggaagatggmsaaaaggttaaggctggcgacaagctatttgcgctttcgacctcacgtttcggcgcaggaggtagcgtgcagcagcagttgaaaacggaggcagttttgaagaaaacgttggcagaacaggaactgggtcgtctgaagctgatacacgggaatgaaacgcgcagccttaaagcaactgtcgaacgtttggaaaaccaggaactccatatttcgcaacagatagacggtcagaaaaggcgcattagacttgcggaagaaatgttgcagaaatatcgtttcctatccgccaatga

SEQ ID NO: 420 - protein, 188 aa, Neisseria meningitidis
  misc_feature (81)..(81): Xaa= any amino acid
  misc_feature (92)..(92): Xaa= any amino acid
  misc_feature (187)..(187): Xaa= any amino acid
MNRPKQPFFRPEVAVARQTSLTGKVILTRPLSFSLWTTFASISALLIILFLIFGNYTRKTTVEGQILPASGVIRVYAPDTXTITAKFVEDGXKVKAGDKLFALSTSRFGAGGSVQQQLKTEAVLKKTLAEQELGRLKLIHGNETRSLKATVERLENQELHISQQIDGQKRRIRLAEEMLQKYRFLSXQ

SEQ ID NO: 421 - DNA, 717 bp, Neisseria meningitidis
  misc_feature (21)..(21): N= Unknown
  misc_feature (252)..(252): N= Unknown
  misc_feature (262)..(262): N= Unknown
  misc_feature (695)..(696): N= Unknown
atgaatagacccaagcaaccnttcttccgtcccgaagtcgccgttgcccgccaaaccagcctgacgggtaaagtgattctgacacgaccgttgtcattttccctatggacgacatttgcatcgatatctgcgttattgattatcctgtttttgatatttggtaactatacgcgaaagacaacagtggagggacaaattttacctgcatcgggcgtaatcagggtgtatgcaccggatacggggacaattacngcgaaattcntggaagatggagaaaaggttaaggctggcgacaagctatttgcgctttcgacctcacgtttcggcgcaggagatagcgtgcagcagcagttgaaaacggaggcagttttgaagaaaacgttggcagaacaggaactgggtcgtctgaagctgatacacgggaatgaaacgcgcagccttaaagcaactgtcgaacgtttggaaaaccaggaactccatatttcgcaacagatagacggtcagaaaaggcgcattagacttgcggaagaaatgttgcagaaatatcgtttcctatccgccaatgatgcagtgccaaaacaagaaatgatgaatgtcaaggcagagcttttagagcagaaagccaaacttgatgcctaccgccgagaagaagtcgggctgcttcaggaaatccgcacgcagaatctgacattggnnagcctcccccaagcggcatga

SEQ ID NO: 422 - protein, 238 aa, Neisseria meningitidis
  misc_feature (88)..(88): Xaa= any amino acid
  misc_feature (232)..(232): Xaa= any amino acid
MNRPKQPFFRPEVAVARQTSLTGKVILTRPLSFSLWTTFASISALLIILFLIFGNYTRKTTVEGQILPASGVIRVYAPDTGTITAKFXEDGEKVKAGDKLFALSTSRFGAGDSVQQQLKTEAVLKKTLAEQELGRLKLIHGNETRSLKATVERLENQELHISQQIDGQKRRIRLAEEMLQKYRFLSANDAVPKQEMMNVKAELLEQKAKLDAYRREEVGLLQEIRTQNLTLXSLPQAA

SEQ ID NO: 423 - DNA, 8 bp, Neisseria gonorrhoeae
  misc_feature (1)..(8): N= Unknown
nnnnnnnn

SEQ ID NO: 424 - protein, 188 aa, Neisseria gonorrhoeae
MNRPKQPFFRPEVAIARQTSLTGKVILTRPLSFSLWTTFASISALLIILFLIFGNYTRKTTMEGQILPASGVIRVYAPDTGTITAKFVEDGEKVKAGDKLFALSTSRFGAGGSVQQQLKTEAVLKKTLAEQELGRLKLIHENETRSLKATVERLENQKLHISQQIDGQKRRIRLAEEMLRKYRFLSAQ

SEQ ID NO: 425 - DNA, 545 bp, Neisseria meningitidis
atgctgaatactttttttgccgtattgggcggctgcctgctgctttgccgtgcggcaaatccgtaaatacggcggtacagccgcaaaacgcggtacaaagcgcgccgaaaccggttttcaaagtcatatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 426 - protein, 181 aa, Neisseria meningitidis
  misc_feature (15)..(15): Xaa= any amino acid
MLNTFFAVLGGCLLXLPCGKSVNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 427 - DNA, 546 bp, Neisseria meningitidis
atgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 428 - protein, 181 aa, Neisseria meningitidis
MLKTSFAVLGGCLLLAACGKSENTAEQPQNAVQSAPKPVFKVKYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 429 - DNA, 546 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 430 - protein, 181 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 431 - DNA, 695 bp, Neisseria meningitidis
atggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtacgcttcggttcgaagctgattaa

SEQ ID NO: 432 - protein, 231 aa, Neisseria meningitidis
  misc_feature (142)..(142): Xaa= any amino acid
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVXTAFGFLRRCVRTGCRLVFSDCLYCFARLQAVERDVLHQIGERCLQSWFAIGIPAARFDYFPDCGNDGGRCVCRCEFRCEICRTLRFEAD

SEQ ID NO: 433 - DNA, 789 bp, Neisseria meningitidis
atggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 434 - protein, 262 aa, Neisseria meningitidis
MEDLYIILALGLVAMIAGFIDAIAGGGGLITLPALLLAGIPPVSAIATNKLQAAAATFSATVSFARKGLIDWKKGLPIAAASFVGGVAGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 435 - DNA, 789 bp, Neisseria meningitidis
atggaagatttatacataatactcgctttgggtttggttgcgatgattgccggatttatcgatgcgattgcgggtgggggtggtttgattacgctgcctgcactcttgttggcaggtattcctcccgtgtcggcaattgccaccaacaagctgcaagcagccgctgctacgttttcggctacggtttcttttgcacgcaaaggtttgattgattggaagaaaggtctcccgattgcggcagcatcgtttgcaggcggcgtggtcggtgcattatcggtcagcttggtttccaaagatattctgctggcggtcgtgccggttttgttgatatttgtcgcgctgtattttgtgttttcgcccaagctcgacggcagtaaggaaggcaaagccagaatgtctttttttctgttcggtctgacggttgcaccacttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 436 - protein, 262 aa, Neisseria meningitidis
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIAATMAVGAFVGANLGARFAVRFGSKLIKPLLIVISISMAVKLLIDERNPLYQMIVSMF

SEQ ID NO: 437 - DNA, 8 bp, Neisseria gonorrhoeae
  misc_feature (1)..(8): N= Unknown
nnnnnnnn

SEQ ID NO: 438 - protein, 231 aa, Neisseria gonorrhoeae
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVATAFGFLRRCVRTGCRLVFSDCLYCFARLQAVERDVLHQIGERCLQSWFAIGIPAARFDYFPDCGNDGGRCVCRCEFRCEICRPLRFEAD

SEQ ID NO: 439 - DNA, 789 bp, Neisseria gonorrhoeae
atggaagatttatacataatactcgctttgggtttggttgcgatgatcgccggatttatcgatgcgattgcgggcgggggtggtttgattacgctgcctgcactcttgttggcaggtattcctcccgtgtcggcaattgccaccaacaagctgcaagcagccgctgctacgttttcggctacggtttcttttgcacgcaaaggtttgattgattggaagaaaggtctcccgattgccgcagcatcgtttgcaggcggcgtggtcggtgcattatcggtcagcttggtttccaaagatattttgctggcggtcgtgccggttttgttgatatttgtcgcgctgtattttgtgttttcgcccaagctcgacggcagtaaggaaggcaaagccagaatgtctttttttctattcgggctgacggttgcaccgcttttgggtttttacgacggtgtgttcggaccgggtgtcggctcgttttttctgattgcctttattgttttgctcggctgcaagctgttgaacgcgatgtcttacaccaaattggcgaacgttgcttgcaatcttggttcgctatcggtattcctgctgcacggttcgattattttcccgattgtggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaa

SEQ ID NO: 440 - protein, 262 aa, Neisseria gonorrhoeae
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIVATMAVGAFVGANLGARFAVRFGSKLIKPLLIVISISMAVKLLIDERNPLYQMIVSMF

SEQ ID NO: 441 - DNA, 635 bp, Neisseria meningitidis
ctgctagggtattgcatcggttatcggtacggctgttgcagcaaaaccagccgcagacggattatttggtcaaattcggatcgttttgggcgagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcaggggaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctga

SEQ ID NO: 442 - protein, 210 aa, Neisseria meningitidis
  misc_feature (31)..(31): Xaa= any amino acid
  misc_feature (181)..(181): Xaa= any amino acid
  misc_feature (186)..(186): Xaa= any amino acid
  misc_feature (201)..(201): Xaa= any amino acid
LLGIASVIGTLLQQNQPQTDYLVKFGSFWAXIFGFLGLYDVYASAWFVVIMMFLVVSTSLCLIRNVPPFWREMKSFREKVKEKSLAAMRHSSLLDVKIAPEVAKRYLEVQGFQGKTINREDGSVLIAAKKGTMNKWGYIFAHVALIVICLGGLIDSNLLLKLGMLTGRIFRTIRRFMPRIXKPESXFGCVQSLIGQRQYFXRGRVRMWFS

SEQ ID NO: 443 - DNA, 8 bp, Neisseria gonorrhoeae
  misc_feature (1)..(8): N= Unknown
nnnnnnnn

SEQ ID NO: 444 - protein, 241 aa, Neisseria meningitidis
  misc_feature (170)..(170): Xaa= any amino acid
  misc_feature (186)..(186): Xaa= any amino acid
MSKSRISPTLLSRPWFAFFSSMRFAVALLSLLGIASVIGTVLQQNQPQTDYLVKFGPFWTRIFDFLGLYDVYASAWFVVIMMFLVVSTSLCLIRNVPPFWREMKSFREKVKEKSLAAMRHSSLLDVKIAPEVAKRYLEVRGFQGKTVSREDGSVLIAAKKGTMNKWGYIXAHVALIVICLGRLINXNLLLKLGMLAGSIFRNNRRVMPRISKPESIWGGVQSLIKGQRQYFQRGKVRMWFS

SEQ ID NO: 445 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 446 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 447 - DNA, 1056 bp, Neisseria meningitidis
  misc_feature (166)..(166): N= Unknown
  misc_feature (174)..(174): N= Unknown
  misc_feature (195)..(195): N= Unknown
  misc_feature (586)..(586): N= Unknown
  misc_feature (588)..(588): N= Unknown
  misc_feature (645)..(645): N= Unknown
  misc_feature (662)..(662): N= Unknown
  misc_feature (763)..(763): N= Unknown
  misc_feature (883)..(883): N= Unknown
  misc_feature (915)..(915): N= Unknown
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacnaactcccntcacctgccgaaatacaaaancgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgatnangttgcgggcgaactggaaaaatacggcattcaaaattatctggtcgaaatcggcggngagttgcacggcaaagncaaaaacgcgcgcggcgaaccttggcgcatcggcatcgaacagcccaacatcgtccaaggcggcaatacgcagattatcgtcccgctgaacaaccgttcgnttgccacttccggcgattaccgtattttccacgtcgataaaagcggcaaacgcctctcccatatcattaatccgaacaacaaacgacccatcagccacaacctcgcctccatcagcgtgntcgcagacagtgcgatgacggcggacggcttntccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 448 - protein, 351 aa, Neisseria meningitidis
  misc_feature (56)..(56): Xaa= any amino acid
  misc_feature (65)..(65): Xaa= any amino acid
  misc_feature (196)..(196): Xaa= any amino acid
  misc_feature (221)..(221): Xaa= any amino acid
  misc_feature (255)..(255): Xaa= any amino acid
  misc_feature (295)..(295): Xaa= any amino acid
  misc_feature (305)..(305): Xaa= any amino acid
MPSETRLPNFIRTLIFALSFIFLNACSEQTAQTVTLQGETMGTTYTVKYLSNNRDXLPSPAEIQXRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDXVAGELEKYGIQNYLVEIGGELHGKXKNARGEPWRIGIEQPNIVQGGNTQIIVPLNNRSXATSGDYRIFHVDKSGKRLSHIINPNNKRPISHNLASISVXADSAMTADGXSTGLFVLGETEALKLAEREKLAVFLIVRDKGGYRTAMSSEFEKLLR

SEQ ID NO: 449 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 450 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 451 - DNA, 789 bp, Neisseria meningitidis
ccgtgccgccgacagggcgacgacgtgtatgcggcgcacgcgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagcckaytggcaatcggcgtgatgggcggcagggccggccagcacgcwtcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgca

SEQ ID NO: 452 - protein, 263 aa, Neisseria meningitidis
  misc_feature (60)..(60): Xaa= any amino acid
PCRRQGDDVYAAHASRQKLWLRFIGGRSHQNIRGGAAADGWRKGVQIGGEVFVRQNEGSXLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSA

SEQ ID NO: 453 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaactacaatagcggcatactcgccgtcgataatatgcccgttgttaagaaatatattacagatacttacggggataatttaaaggatgcggttaagaagcaattacaggatttatacaaaacaagacccgaagcttgggaagaaaataaaaaacggactgaggaggcgtatatagaacagcttggaccaaaatttagtatactcaaacagaaaaaccccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatatgctggaaacttccgataatgcccgcatccgcctgaacacgaaagatgaaaaactgaccgtccataaagcgtatcagggcggtgcggatttcctgttcggctacgacgtgcgggagtcggacaaacccgccctgacctttgaagaaaaagtcagcggacaatccggcgtggttttggaacgccggccggaaaatctgaaaacgctcgacgggcgcaaactgattgcggcggaaaaggcagactctaattcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgttcgggctgcgtgccgccgacaggggcgacgacgtgtatgccgccgatccgtcccgtcaaaaattgtggctgcgcttcatcggcggccggtcgcatcaaaatatacggggcggcgcggctgcggacgggcggcgcaaaggcgtgcaaatcggcggcgaggtgtttgtacggcaaaatgaaggcagccggctggcaatcggcgtgatgggcggcagggctggccagcacgcatcagtcaacggcaaaggcggtgcggcaggcagttatttgcatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcgttgtcggaaaaggcaataatgtgcggttttacctgcaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcgctcgaagggcggttcggcattgaagccggttggaaaggccatatgtccgcacgcatcggatacggcaaaaggacggacggcgacaaagaagccgcattgtcgctcaaatggctgttttga

SEQ ID NO: 454 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 455 - DNA, 8 bp, Neisseria gonorrhoeae
  misc_feature (1)..(8): N= Unknown
nnnnnnnn

SEQ ID NO: 456 - protein, 627 aa, Neisseria gonorrhoeae
KKLRDRNSEYWKEETYHIKSNGRTYPNIPALFPKHPFDPFENINNSKKISFYDKEYTEDYLVGFARGFGVEKRNGEEEKPLRQYFKDCVNTENSNNDNCKISSFGNYGPILIKSDIFALASQIKNSHINSEILSVGNYIEWLRPTLNKLTGWQEHLYAGLDPFHYIEVTDNSHVIGQTIDLGALELTNSLWKPRWNSNIDYLITKNAEIRFNTKNESLLVKEDYAGGARFRFAYDLKDKVPEIPVLTFEKNITGTSDIIFEGKALDNLKHLDGHQIVKVNDTADKDAFRLSSKYRKGIYTLSLQQRPEGFFTKVQERDDIAIYAQQAQAANTLFALRLNDKNSDIFDRTLPRKGLWLRVIDGHSNQWVQGKTAPVEGYRKGVQLGGEVFTWQNESNQLSIGLMGGQAEQRSTFRNPDTDNLTTGNVKGFGAGVYATWHQLQDKQTGAYVDSWMQYQRFRHRINTEYATERFTSKGITASIEAGYNALLAEHFTKKGNSLRVYLQPQAQLTYLGVNGKFSDSENAQVNLLGSRQLQSRVGVQAKAQFAFTNGVTFQPFVAVNSIYQQKPFGVEIDGDRRVINNKTVIETQLGVAAKIKSHLTLQASFNRQTSKHHHAKQGALNLQWTF

SEQ ID NO: 457 - DNA, 380 bp, Neisseria meningitidis
  misc_feature (379)..(379): N= Unknown
gcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataaaaaaggcacagtaacaggagggcatagtctaacccgtggtgatgtacgggtgatacaacaaacctcggcacctgataaacatggggtttatcaagcgacagtggaaattna

SEQ ID NO: 458 - protein, 127 aa, Neisseria meningitidis
  misc_feature (119)..(119): Xaa= any amino acid
  misc_feature (127)..(127): Xaa= any amino acid
AEYVQFSIDLFSVGKSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGXLSSDSGNX

SEQ ID NO: 459 - DNA, 683 bp, Neisseria meningitidis
  misc_feature (12)..(12): N= Unknown
  misc_feature (34)..(34): N= Unknown
gcagtgtgcctnccgatgcatgcacacgcctcanatttggcaaacgattcttttatccggcaggttctcgaccgtcagcatttcgaacccgacgggaaataccacctattcggcagcaggggggaacttgccgagcgccagtctcatatcggattgggaaaaatacaaagccatcagttgggcaacctgatgattcaacaggcggccattaaaggaaatatcggctacattgtccgcttttccgatcacgggcacgaagtccattccccsttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagttacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgctgcaggagaaattgt

SEQ ID NO: 460 - protein, 227 aa, Neisseria meningitidis
  misc_feature (12)..(12): Xaa= any amino acid
AVCLPMHAHASXLANDSFIRQVLDRQHFEPDGKYHLFGSRGELAERQSHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEI

SEQ ID NO: 461 - DNA, 8 bp, Neisseria gonorrhoeae
  misc_feature (1)..(8): N= Unknown
nnnnnnnn

SEQ ID NO: 462 - protein, 298 aa, Neisseria meningitidis
  misc_feature (93)..(93): Xaa= any amino acid
  misc_feature (108)..(108): Xaa= any amino acid
RRLKHCCHARLGSAFHRKQDGAHQRFGRYGATQRLCRSSHPRLGSPKPQCRTRHRSRQQYLYGSHPHQRDWSCPGKIQLGRHHGTSCRAVADXRDRICEREIRRQRQXCRCRLGKIPSLSIPKYPLKLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGAVTGGHSLTRGDVRVIQQTSAPDKHGVLSSDSGN

SEQ ID NO: 463 - DNA, 1887 bp, Neisseria gonorrhoeae
  misc_feature (175)..(175): N= Unknown
ttgggcatttcccgcaaaatatcccttattctgtccatactggcagtgtgcctgccgatgcatgcacacgcctcagatttggcaaacgatccctttatccggcaggttctcgaccgtcagcatttcgaacccgacgggaaataccacctattcggcagcaggggggagcttgccnagcgcaacggccatatcggattgggaaacatacaaagccatcagttgggccacctgatgattcaacaggcggccgttgaaggaaatatcggctacattgtccgcttttccgatcacgggcacaaattccattcgcccttcgacaaccatgcctcacattccgattctgacgaagccggtagtcccgttgacggattcagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggcgctatgctgacgcaaggagtaggcgacggattcaaacgcgccacccgatacagccccgagctggacagatcgggcaatgccgccgaagccttcaacggcactgcagatatcgtcaaaaacatcatcggcgcggcaggagaaattgtcggcgcaggcgatgccgtgcagggtataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgtccggggaaaatacggcttgggcggcatcacggcacatcctgtcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatag

SEQ ID NO: 464 - protein, 628 aa, Neisseria gonorrhoeae
  misc_feature (59)..(59): Xaa= any amino acid
LGISRKISLILSILAVCLPMHAHASDLANDPFIRQVLDRQHFEPDGKYHLFGSRGELAXRNGHIGLGNIQSHQLGHLMIQQAAVEGNIGYIVRFSDHGHKFHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPVKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGVYQATVEIKKPDGSWEVKTKKGGKVMTKHTMFPKDWDEARIRAEVTSAWESRIMLKDNKWQGTSKSGIKIEGFTEPNRTAYPIYE

SEQ ID NO: 465 - DNA, 1671 bp, Neisseria meningitidis
ttgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggtcatatcggattgggaaacatacaaagccatcagttgggcaacctgttcatccagcaggcggccattaaaggaaatatcggctacattgtccgcttttccgatcacgggcacgaagtccattcccccttcgacaaccatgcctcacattccgattctgatgaagccggtagtcccgttgacggattcagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgtcgaccgtttccacaataccggtagtatgctgacgcaaggagtaggcgacggattcaaacgcgccacccgatacagccccgagctggacagatcgggcaatgccgccgaagctttcaacggcactgcagatatcgtcaaaaacatcatcggcgcggcaggagaaattgtcggcgcaggcgatgccgtgcagggtataagcgaaggctcaaacattgctgttatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttacggcagtcatccccgtcaaagggattggagctgttcggggaaaatacggcttgggcggcatcacggcacatcctgtcaagcggtcgcagatgggcgagatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggaaagaatgtgaaactggcaaacaaacgccacccgaagaccaaagtgccgtttgacggtaaagggtttccgaattttgaaaaagacgtaaaatacgatacgagaattaataccgctgtaccacaagtgaatcctatagatgaacccgtctttaatcctaaaggttctgtcggatcggctcattcttggtctataactgccagaattcaatacgcaaaattaccaaggcaaggtagaatcagatatatcccacctaaaaattactctccttcagcaccgctaccaaaaggacctaataatggatatttggataaatttggtaatgaatggactaaaggtccatcaagaactaaaggtcaagaatttgaatgggatgttcaattgtctaaaacaggaagagagcaacttggatgggctagtagggatggtaagcatttaaatatatcaattgatggaaagattacacacaaatga

SEQ ID NO: 466 - protein, 556 aa, Neisseria meningitidis
LGISRKISLILSILAVCLPMHAHASDLANDSFIRQVLDRQHFEPDGKYHLFGSRGELAERSGHIGLGNIQSHQLGNLFIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLVDRFHNTGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFTAVIPVKGIGAVRGKYGLGGITAHPVKRSQMGEIALPKGKSAVSDNFADAAYAKYPSPYHSRNIRSNLEQRYGKENITSSTVPPSNGKNVKLANKRHPKTKVPFDGKGFPNFEKDVKYDTRINTAVPQVNPIDEPVFNPKGSVGSAHSWSITARIQYAKLPRQGRIRYIPPKNYSPSAPLPKGPNNGYLDKFGNEWTKGPSRTKGQEFEWDVQLSKTGREQLGWASRDGKHLNISIDGKITHK

SEQ ID NO: 467 - DNA, 357 bp, Neisseria meningitidis
atgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctg

SEQ ID NO: 468 - protein, 119 aa, Neisseria meningitidis
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGL

SEQ ID NO: 469 - DNA, 1419 bp, Neisseria meningitidis
atgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataa

SEQ ID NO: 470 - protein, 472 aa, Neisseria meningitidis
MNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGLLLLYMLAMPFVLQKAAAKTDFRHIAVCAAVVAAAGYFTGHLSYYDRGRMANIFGANNFYYAKSQAMLYTVSQNADFITAGLVDPVFLPLGNQQRAATHLNEPKSQKILFIVAESWGLPANPELQNATFAKLLAQKDRFSVWESGSFPFIGATVEGEMRELCAYGGLRGFALRRAPDEKFARCLPNRLKQEGYATFAMHGAGSSLYDRFSWYPRAGFQEIKTAENLIGKKTCAIFGGVCDSELFGEVSAFFKKHDKGLFYWMTLTSHADYPESDIFNHRLKCTEYGLPAETDLCRNFSLHTQFFDQLADLIQRPEMKGTEVIIVGDHPPPVGNLNETFRYLKQGHVAWLNFKIK

SEQ ID NO: 471 - DNA, 1419 bp, Neisseria meningitidis
  misc_feature (87)..(88): N= Unknown
  misc_feature (156)..(156): N= Unknown
  misc_feature (196)..(196): N= Unknown
  misc_feature (209)..(209): N= Unknown
  misc_feature (224)..(224): N= Unknown
  misc_feature (319)..(319): N= Unknown
  misc_feature (486)..(486): N= Unknown
  misc_feature (765)..(765): N= Unknown
  misc_feature (1102)..(1102): N= Unknown
  misc_feature (1173)..(1173): N= Unknown
  misc_feature (1231)..(1231): N= Unknown
  misc_feature (1394)..(1394): N= Unknown
  misc_feature (30)..(30): N= Unknown
atgaatattcacaccctgctctccaaacaatggacgctgccgccattcctgccgaaacggctgctgctgtccctgctgatactgctnncccccaatgcggtgttttgggttttggcactgctgaccgccaccgcccgcccgattgtcaatttggantaccttcccgccgcgctgctgatcgccctgccttggcgtntcgtcaaaattgncggcgtattggcgtnttggctggcggttttgtttgacgggctgatgatggtgatccaactcttcccttttatggatctcatcggcgccatcaacctcgtccccttcatcntgaccgcccccgccctttatcagataatgaccgggctgttactgctgtatatgctggcgatgccgtttgtgttgcagaaagccgccgccaaaaccgacttccgacacattgccgcctgtgccgccgttgtggtggcagccggctattttaccggccatttgagttantacgaccgggggcggatggccaatatcttcggcgcaaacaacttctattacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagancgtttttcggtttgggaaagcggcagttttcccttcatcggcgcgacgatcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcanttttcaaaaaacacgacaagggactgttttactggatgacgctgaccagccacgccgactatcccgaatcngacattttcaaccacaggctcaaatgcaccgaatatggcctgcccgccgaaaccgacntctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgnctggctgaacttcaaaatcaaataa

SEQ ID NO: 472 - protein, 472 aa, Neisseria meningitidis
  misc_feature (30)..(30): Xaa= any amino acid
  misc_feature (52)..(52): Xaa= any amino acid
  misc_feature (66)..(66): Xaa= any amino acid
  misc_feature (70)..(70): Xaa= any amino acid
  misc_feature (75)..(75): Xaa= any amino acid
  misc_feature (107)..(107): Xaa= any amino acid
  misc_feature (162)..(162): Xaa= any amino acid
  misc_feature (255)..(255): Xaa= any amino acid
  misc_feature (368)..(368): Xaa= any amino acid
  misc_feature (411)..(411): Xaa= any amino acid
  misc_feature (465)..(465): Xaa= any amino acid
MNIHTLLSKQWTLPPFLPKRLLLSLLILLXPNAVFWVLALLTATARPIVNLXYLPAALLIALPWRXVKIXGVLAXWLAVLFDGLMMVIQLFPFMDLIGAINLVPFIXTAPALYQIMTGLLLLYMLAMPFVLQKAAAKTDFRHIAACAAVVVAAGYFTGHLSXYDRGRMANIFGANNFYYAKSQAMLYTVSQNADFITAGLVDPVFLPLGNQQRAATHLNEPKSQKILFIVAESWGLPANPELQNATFAKLLAQKXRFSVWESGSFPFIGATIEGEMRELCAYGGLRGFALRRAPDEKFARCLPNRLKQEGYATFAMHGAGSSLYDRFSWYPRAGFQEIKTAENLIGKKTCAIFGGVCDSELFGEVSAXFKKHDKGLFYWMTLTSHADYPESDIFNHRLKCTEYGLPAETDXCRNFSLHTQFFDQLADLIQRPEMKGTEVIIVGDHPPPVGNLNETFRYLKQGHVXWLNFKIK

SEQ ID NO: 473 - DNA, 8 bp, Neisseria gonorrhoeae
  misc_feature (1)..(8): N= Unknown
nnnnnnnn

SEQ ID NO: 474 - protein, 209 aa, Neisseria gonorrhoeae
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAARYFTGPFELLRTGGRWQYVQHRRLLLSGSRASFRRRQKADVLRRLGNPYASMGNGG

SEQ ID NO: 475 - DNA, 1419 bp, Neisseria gonorrhoeae
atgaatattcacgccctgctctccgaacaatggacgctgccgccattcctgccgaaacggctgctgctgtccctgctgatactgctggcccccaatgcggtgttttgggttttggcactgctgaccgccaccgcccgcccgattgtcaatttggactaccttcccgccgcgctgctgatcgccctgccttggcgtttcgtcaaaattgccggcgtattggcgttttggccggcggttttgtttgacgggctgatgatggtgatccaactcttcccttttatggacctcatcggcgccatcaacctcgtccccttcatcctgaccgcccccgccccttatcagataatgaccgggctgttgctgctgtatatgctggcgatgccgtttgtgttgcaaaaagccgccgtcaaaaccgacttccgacacattgccgtctgtgccgccgttgtggcggcagccggctatttcaccggccatttgagttactacgaccgggggcggatggccaatatcttcggcgcaaacaacttctattacgccaaaagtcaggcgatgctctacaccgtcagccagaatgccgactttattaccgccggcctggtcgaccccgtcttcctccccttgggcaatcagcagcgtgccgccacgcggctgagtgagccgaaatctcaaaaaatcctctttatcgtcgccgaatcttgggggctgccgggcaatcccgagcttcaaaacgccacttttgccaaactgctggcgcaaaaagaccgtttttcggtttgggaaagcggcagttttcccttcatcggcgcgacggtcgaaggcgaaatgcgcgaattgtgcgcctacggcggtttgcgcgggttcgcactgcgccgcgcgcccgacgaaaaatttgcccgctgcctccccaaccgtttgaaacaagaaggttacgccacctttgcgatgcacggcgcgggtagttcgctttacgaccgcttcagctggtatccgagggcgggctttcaaaaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatacggcctgcccgccgaaaccgacctctgccgcaatttcagcctgcacacccaattcttcgaccaactggcggatttgatccgacgccccgaaatgaaaggcacggaagtcatcatcgtcggcgaccatccgccgcccgtcggcaacctcaatgaaaccttccgctacctcaaacagggacacgtcgcctggctgcacttcaaaatcaaataa

SEQ ID NO: 476 - protein, 472 aa, Neisseria gonorrhoeae
MNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAAGYFTGHLSYYDRGRMANIFGANNFYYAKSQAMLYTVSQNADFITAGLVDPVFLPLGNQQRAATRLSEPKSQKILFIVAESWGLPGNPELQNATFAKLLAQKDRFSVWESGSFPFIGATVEGEMRELCAYGGLRGFALRRAPDEKFARCLPNRLKQEGYATFAMHGAGSSLYDRFSWYPRAGFQKIKTAENLIGKKTCAIFGGVCDSELFGEVSAFFKKHDKGLFYWMTLTSHADYPESDIFNHRLKCTEYGLPAETDLCRNFSLHTQFFDQLADLIRRPEMKGTEVIIVGDHPPPVGNLNETFRYLKQGHVAWLHFKIK

SEQ ID NO: 477 - DNA, 415 bp, Neisseria meningitidis
gtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgaattcaacgtcggttatatcgccagtgcggttttggctttggttttccttgcactgggcgcgtagcgccgaacggcaacggcgaacagtgcagatggcgggcggcaaatataacgggcaattgatcaatatgtacgcc

SEQ ID NO: 478 - protein, 139 aa, Neisseria meningitidis
  misc_feature (113)..(113): Xaa= any amino acid
  misc_feature (121)..(121): Xaa= any amino acid
VSGRYRALDRVSKIIIVTLSIATLAAAGIAMSRGMQMQSDFIEPTPWTLAGLGFLIALMGWMPAPIEISAINSLWVTEKQRINPSEYRDGIFEFNVGYIASAVLALVFLALGXVAPNGNGXTVQMAGGKYNGQLINMYA

SEQ ID NO: 479 - DNA, 1254 bp, Neisseria meningitidis
atgtccgaacaacatatttcgacttggaaaagtaaaatcaacgcattgggtccggggatcatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgtcgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggttaaaggtgatgaaaaacacaaactcacatcaggtatgaatgcccttgcattggcaggcttgatttatctgaccggttttaccgttttgttcttattgaatttggcgggaatgttcaaatga

SEQ ID NO: 480 - protein, 417 aa, Neisseria meningitidis
MSEQHISTWKSKINALGPGIMMASAAVGGSHLIASTQAGALYGWQIALIIILTNLFKYPFFRFSAHYTLDTGKSLIEGYAEKSRVYLWVFLILCILSATINAGAVAIVTAAIVKMAIPSLMFDAGTVAALIMASCLIILVSGRYRALDRVSKIIIVTLSIATLAAAGIAMSRGMQMQSDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGKDKTGNAEFFAWNIWVAGSGLAVIFWFDGVMANLLKFAMIAAFVSAPVFAWLNYRLVKGDEKHKLTSGMNALALAGLIYLTGFTVLFLLNLAGMFK

SEQ ID NO: 481 - DNA, 1254 bp, Neisseria meningitidis
atgtccgaacaacatatttcgacttggaaaagtaaaatcaacgcattgggaccggggattatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgttgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggtcaaaggtgatgaaaaacacaaactcacatcaggtatgaatgcccttgcattggcaggcttgatttatctgaccggttttaccgttttgttcttattgaatttggcgggaatgttcaaatga

SEQ ID NO: 482 - protein, 417 aa, Neisseria meningitidis; identical to SEQ ID NO: 480

SEQ ID NO: 483 - DNA, 8 bp, Neisseria gonorrhoeae
  misc_feature (1)..(8): N= Unknown
nnnnnnnn

SEQ ID NO: 484 - protein, 269 aa, Neisseria gonorrhoeae
MPKKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMGGGKYIGQLINMYAVTIGGGSRPLVAFIAFACMYGAASTVVDGYARAIAEPVRLLRGKDKTARPIVLLEKLGGRHRFGRDFLV

SEQ ID NO: 485 - DNA, 1014 bp, Neisseria gonorrhoeae
aagaaaagctgcgtttatttgtgggtttttttgattttgtgtatcgcctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgtgtttccaaaatcatcattgttactttgagcatcgccacgcttgccgccgccggcatcgctatgtcgcgcggtatgcagatgcagcccgattttatcgagccgacaccgtggacgcttgccggtttgggcttcctgatcgcgctgatgggctggatgcccgcgccgatcgaaatttccgccatcaattctttgtgggtaaccgaaaaacaacgcatcaatccttctgaataccgcgacgggattttcgatttcaacgtcggttatatcgccagtgcggttttggctttggttttccttgcactgggcgcgtttgtgcaatacggcaacggcgaagcagtgcagatggcgggcggcaaatatatcgggcaattgattaatatgtatgccgtaaccatcggcggctggtctcgtccgctggtggcgtttatcgcgtttgcctgtatgtacggcacgacgattaccgttgtggacggttatgcgcgtgccattgccgaacccgtgcgcctgctgcgcggcagggataaaaccggcaacgccgagttgtttgcctggaatatttgggtggcgggcagcggtttggcggtgattttctggtttgacggcgcaatggcggaactgctcaaatttgcgatgattgccgcctttgtgtccgcccctgtgttcgcctggctcaactaccgcctcgtcaaaggggacaaacgccacaggcttaccgccggtatgaacgcccttgccattgtcggcctgctctacctggccgggtttgccgttttgttcctgttgaaccttaccggacttttggcatag

SEQ ID NO: 486 - protein, 337 aa, Neisseria gonorrhoeae
KKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGRDKTGNAELFAWNIWVAGSGLAVIFWFDGAMAELLKFAMIAAFVSAPVFAWLNYRLVKGDKRHRLTAGMNALAIVGLLYLAGFAVLFLLNLTGLLA

SEQ ID NO: 487 - DNA, 309 bp, Neisseria meningitidis
ttgcgggaaacggcatatgttttggatagttttgatcgttattttgttgttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccacgccgtcaaaacggcagtgtattggctgtttgtcggtgtcgtccgtttctgccgaaactatctggcgcacgaatccgaaccggacaggcccgttccgcct

SEQ ID NO: 488 - protein, 103 aa, Neisseria meningitidis
LRETAYVLDSFDRYFVVALAGLFFVRAQSEREWMREVSAWQEKKGEKQAELPEIKDGMPDFPELALMLFHAVKTAVYWLFVGVVRFCRNYLAHESEPDRPVPP

SEQ ID NO: 489 - DNA, 3045 bp, Neisseria meningitidis
atgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttga

SEQ ID NO: 490 - protein, 1014 aa, Neisseria meningitidis
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSHMFDADKEAFSESADYGFEPYFEKQHPSAFSAVKAENARNAPFHRHAGQGKGQAEAKSPDVSQGQSVSDGTAVRDARRRVSVNLKEPNKATVSAEARISRLIPESQTVVGKRDVEMPSETENVFTETVSSVGYGGPVYDETADIHIEEPAAPDAWVVEPPEVPKVPMTAIDIQPPPPVSEIYNRTYEPPSGFEQVQRSRIAETDHLADDVLNGGWQEETAAIADDGSEGAAERSSGQYLSETEAFGHDSQAVCPFENVPSERPSCRVSDTEADEGAFPSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLLPGTAYPQRVHGAFASDEEVHRVVEYLKQFGEPDYVDDILSGGGSEELPGIGRSGDDETDPMYDEAVSVVLKTRKASISGVQRALRIGYNRAARLIDQMEAEGIVSAPEHNGNRTILVPLDNA

SEQ ID NO: 491 - DNA, 3045 bp, Neisseria meningitidis
  misc_feature (864)..(864): N= Unknown
  misc_feature (882)..(882): N= Unknown
  misc_feature (943)..(943): N= Unknown
  misc_feature (1094)..(1094): N= Unknown
  misc_feature (1118)..(1118): N= Unknown
  misc_feature (1224)..(1224): N= Unknown
  misc_feature (1517)..(1517): N= Unknown
  misc_feature (1644)..(1644): N= Unknown
  misc_feature (1653)..(1653): N= Unknown
  misc_feature (1679)..(1679): N= Unknown
  misc_feature (1800)..(1800): N= Unknown
  misc_feature (2296)..(2296): N= Unknown
  misc_feature (2385)..(2385): N= Unknown
  misc_feature (2790)..(2790): N= Unknown
  misc_feature (2877)..(2877): N= Unknown
  misc_feature (3033)..(3033): N= Unknown
atgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaatcgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaggaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccgtatgttcgatgcggacaaagaagcgttttccgagtctgcggattacggatttgagccgtattttgagaagcagcatccgtctgccttttctgcagtcaaagccgaaaatgcacggaatgcgccgttccgccgtcatgcagggcagggnaaagggcaggcggaggcnaaatccccggatgtttcccaagggcagtccgtttcagacggcacagccgtccgcgatgccngccgccgcgtttccgtcaatttgaaagaaccgaacaaggcaacggtttctgcggaggcgcggatttcgcgcctgattccggaaagtcggacggttgtcgggaaacgggatgtcgaaatgccgtctgaaaccgaaaatgttttcacggaaantgtttcgtctgtgggatacggcgntccggtttatgatgaaactgccgatatccatattgaagaacctgccgcgcccgatgcttgggtggtcgaaccacccgaagtgccgaaagttcccatgcccgcaatngatattccgccgccgcctcccgtatcggaaatctacaaccgtacctatgaaccgccggcaggattcgagcaggtgcaacgcagccgcattgccgaaaccgatcatcttgccgatgatgttttgaatggaggttggcaggaggaaaccgccgctattgcgaatgacggcagtgagggtgtggcagagcggtcaagcgggcaatatttgtcggaaaccgaagcgttcgggcatgacagtcaggcggtttgtccgtttgaaaatgtgccgtctgaacgcccgtcccgccgggcatnggatacggaagcggatgaaggggcgttccaatctgaagaaaccggtgcggtatccgaacacctgccgacaaccgacctgcttctgccgccgctgttcaatcccggggcgacgcaaaccgaagaaganctgttgganaacagcatcaccatcgaagaaaaatnggcggagttcaaagtcaaggtcaaggttgtcgattcttattccggccccgtgattacgcgttatgaaatcgaacccgatgtcggcgtgcgcggcaattccgttctaaatctggaaaaaganttggcgcgttcgctcggcgtggcttccatccgcgttgtcgaaaccatcctcggcaaaacctgtatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggcaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgcaatcttgcgggtntcaatcaaaaaatcgccgaagccgcagcaaggggggagaaaatcggcaacccgttcagcctcacgcccgacaatcccgaacctttgganaaattgccgtttatcgtggtcgtggttgatgagtttgccgacctgatgatgacggcaggcaagaaaatcgaagaactgattgcccgcctcgcccaaaaagcccgcgcggcaggcatccatcttatccttgccacacaacgccccagtgtcgatgtcatcacgggtctgattaaggcgaacatcccgacgcgtatcgcgttccaagtgtccagcaaaatcgacagccgcacgattcttgaccaaatgggtgcggaaaacctgctcgggcagggcgatatgctgttcctgccgccgggtacggcctatccgcagcgcgttcacggcgcgtttgcctcggatgaagaggtgcaccgcgtggtcgaatatctgaaacagtttggcgaaccggactatgttgacgatatnttgagcggcggtatgtccgacgatttgctgggaatcagccggagcggcgacggcgaaaccgatccgatgtacgacgaggccgtgtcngttgttttgaaaacgcgcaaagccagcatttctggcgtgcagcgcgcattgcgtatcggctataatcgcgccgcgcgtctgattgaccagatggaggcggaaggcattgtgtccgcaccggaacacaacggcaaccgtacgattctcgtccccttngacaatgcttga

SEQ ID NO: 492 - protein, 1015 aa, Neisseria meningitidis
  misc_feature (315)..(315): Xaa= any amino acid
  misc_feature (365)..(365): Xaa= any amino acid
  misc_feature (373)..(373): Xaa= any amino acid
  misc_feature (409)..(409): Xaa= any amino acid
  misc_feature (507)..(507): Xaa= any amino acid
  misc_feature (549)..(549): Xaa= any amino acid
  misc_feature (552)..(552): Xaa= any amino acid
  misc_feature (561)..(561): Xaa= any amino acid
  misc_feature (601)..(601): Xaa= any amino acid
  misc_feature (767)..(767): Xaa= any amino acid
  misc_feature (796)..(796): Xaa= any amino acid
  misc_feature (931)..(931): Xaa= any amino acid
  misc_feature (1012)..(1012): Xaa= any amino acid
MFWIVLIVILLLALAGLFFVRAQSEREWMREVSAWQEKKGEKQAELPEIKDGMPDFPELALMLFHAVKTAVYWLFVGVVRFCRNYLAHESEPDRPVPPASANRADVPTASDGYSDSGNGTEEAETEEAEAAEEEAADTEDIATAVIDNRRIPFDRSIAEGLMPSESEISPVRPVFKEITLEEATRALNSAALRETKKRYIDAFEKNETAVPKVRVSDTPMEGLQIIGLDDPVLQRTYSRMFDADKEAFSESADYGFEPYFEKQHPSAFSAVKAENARNAPFRRHAGQGKGQAEAKSPDVSQGQSVSDGTAVRDAXRRVSVNLKEPNKATVSAEARISRLIPESRTVVGKRDVEMPSETENVFTEXVSSVGYGXPVYDETADIHIEEPAAPWDAWVVEPPEVPKVPMPAXDIPPPPPVSEIYNRTYEPPAGFEQVQRSRIAETDHLADDVLNGGWQEETAAIANDGSEGVAERSSGQYLSETEAFGHDSQAVCPFENVPSERPSRRAXDTEADEGAFQSEETGAVSEHLPTTDLLLPPLFNPGATQTEEXLLXNSITIEEKXAEFKVKVKVVDSYSGPVITRYEIEPDVGVRGNSVLNLEKXLARSLGVASIRVVETILGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGIPHLLAPVVTDMKLAANALNWCVNEMEKRYRLMSFMGVRNLAGXNQKIAEAAARGEKIGNPFSLTPDNPEPLXKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDXLSGGMSDDLLGISRSGDGETDPMYDEAVSVVLKTRKASISGVQRALRIGYNRAARLIDQMEAEGIVSAPEHNGNRTILVPXDNA

SEQ ID NO: 493 - DNA, 8 bp, Neisseria gonorrhoeae
  misc_feature (1)..(8): N= Unknown
nnnnnnnn

SEQ ID NO: 494 - protein, 925 aa, Neisseria gonorrhoeae
SEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 495 - DNA, 3045 bp, Neisseria gonorrhoeae
atgttttggatagttttgatcgttattgtgttgcttgcgcttgccggcctgttttttgtccgcgcacaatccgaacgcgagtggatgcgcgaggtttctgcgtggcaggaaaagaaaggggaaaaacaggcggagctgcctgaaatcaaagacggtatgcccgattttcccgagttttccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacgggtattcagacagtggaaacgggacggaagaagcggaaacggaagcagcagaagctgcggaggaagaggctgccgatacggaagacattgcaactgccgtaatcgacaaccgccgcatcccattcgaccggagtattgctgaagggttgatgcagtctgaaagcaaaacttcgcccgtccgtccggtttttaaggaaatcactttggaagaagcaacgcgtgctttaagcagcgcggctttaagggaaacgaaaaaacgctatatcgatgcatttgagaaaaacggaacagccgtccccaaagtacgcgtgtccgataccccgatggaagggctgcagattatcggtttggacgaccctgtgcttcaacgcacgtattcccgtatgtttgatgcggacaaagaagcgttttccgagtctgcggattacggatttgagccgtattttgagaagcagcatccgtctgccttttctgcagtcaaagccgaaaatgcacggaatgcgccgttccgccgtcatgcagggcaggagaaagggcaggcggaggcaaaatccccggatgtttcccaagggcagtccgtttcagacggcacagccgtccgcgatgcccgccgccgcgtttccgtcaatttgaaagaaccgaacaaggcaacggtttctgcggaggcgcggatttcgcgcctgattccggaaagtcggacggttgtcgggaaacgggatgtcgaaatgccgtctgaaaccgaaaatgttttcacggaaaccgtttcgtctgtgggatacggcggtccggtttatgatgaagctgccgatatccatattgaagagcctgccgcgcccgatgcttgggtggtcgaaccacccgaagtgccggaggtagccgtacccgaaatcgatattctgccgccgcctcccgtatcggaaatctacaaccgtacctatgagccgccggcaggattcgagcaggcgcaacgcagccgcattgccgaaaccgaccatcttgccgctgatgttttgaatggaggttggcaggaggaaaccgccgctattgcagatgacggcagtgagggtgcggcagagcggtcaagcgggcaatatctgtcggaaaccgaagcgttcgggcatgacagtcaggcggtttgtccgtttgaagatgtgccgtctgaacgcccgtcctgccgggtatcggatacggaagcggatgaaggggcgttccaatcggaagagaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtgattacgcgttatgaaatcgaacccgatgtcggcgtgcgcggcaattccgttctgaatttggaaaaagacttggcgcgttcgctcggcgtggcttccatccgcgttgtcgaaaccatccccggcaaaacctgcatgggtttggaacttccgaacccgaaacgccaaatgatacgcctgagcgaaattttcaattcgcccgagtttgccgaatccaaatccaagctgacgctcgcgctcggtcaggacattaccggacagcccgtcgtaaccgacttgggcaaagcaccgcatttgctggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcacgcacctgctcgcccctgtcgttaccgatatgaagctggcggcaaacgcgctgaactggtgtgttaacgaaatggaaaaacgctaccgcctgatgagctttatgggcgtgcgcaatcttgcgggcttcaaccaaaaaatcgccgaagccgcagcaaggggagaaaaaatcggcaatccgttcagcctcacgcccgacgatcccgaacctttggaaaaactgccgtttatcgtggtcgtggtcgatgagtttgccgatttgatgatgacggcaggcaagaaaatcgaagaactgattgcgcgcctcgcccaaaaagcccgcgcggcaggcatccaccttatccttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgccgccgggtactgcctatccgcagcgcgttcacggcgcgtttgcctcggatgaagaggtgcaccgcgtggtcgaatatctgaagcagtttggcgagccggactatgttgacgatattttgagcggcggcggcagcgaagagctgcccggcatcgggcgcagcggcgacggcgaaaccgatccgatgtacgacgaggccgtatccgttgtcctgaaaacgcgcaaagccagcatttcgggcgtacagcgcgccttgcgcatcggctacaaccgcgccgcgcgtctgattgaccaaatggaagcggaaggcattgtgtccgcaccggaacacaacggcaaccgtacgattctcgtccccttggacaatgcttga

SEQ ID NO: 496 - protein, 1014 aa, Neisseria gonorrhoeae
MFWIVLIVIVLLALAGLFFVRAQSEREWMREVSAWQEKKGEKQAELPEIKDGMPDFPEFSLMLFHAVKTAVYWLFVGVVRFCRNYLAHESEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 497 - DNA, 382 bp, Neisseria meningitidis
atgatttatcaaagaaacctcatcaaagaactctcttttaccgccgtcggcattttcgtcgtcctcttggcggtattggtctccacgcaggcaatcaacctgctcggccgtgccgccgacgggcgtgatcgccatcgatgccgtgttggcattggtcggcttctgggtcattgccatcggtttgtttttaatttaccaaaacgggctgaccctgctttttgaagccgtggaagacggcaaaatccatttttggctcggactgctgcctatgcacattatcatgtttgtccttgcactcatcctgttgcgcgtccgcagtatgcccagccagcccttctggcaggcggttggcaaaagtctgacattgaaaggcggaaaatga

SEQ ID NO: 498 - protein, 127 aa, Neisseria meningitidis
  misc_feature (42)..(42): Xaa= any amino acid
MIYQRNLIKELSFTAVGIFVVLLAVLVSTQAINLLGRAADGXVIAIDAVLALVGFWVIAIGLFLIYQNGLTLLFEAVEDGKIHFWLGLLPMHIIMFVLALILLRVRSMPSQPFWQAVGKSLTLKGGK

SEQ ID NO: 499 - DNA, 1116 bp, Neisseria meningitidis
atgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatga

SEQ ID NO: 500 - protein, 371 aa, Neisseria meningitidis
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAVLVAVMQLWVIPWAELRSREYAEILKQKQELSLVEAGEFNSLGKRNGRVYFVETFDTESGIMKNLFLREQDKNGGDNIIFAKEGNFSLNDNKRTLELRHGYRYSGTPGRADYNQVSFQKLNLIISTTPKLIDPVSHRRTIPTAQLIGSSNPQHQAELMWRISLTVSVLLLCLLAVPLSYFNPRSGHTYNILIAIGLFLIYQNGLTLLFEAVEDGKIHFWLGLLPMHIIMFAVALILLRVRSMPSQPFWQAVGKSLTLKGGK

SEQ ID NO: 501 - DNA, 1116 bp, Neisseria meningitidis
  misc_feature (110)..(110): N= Unknown
  misc_feature (121)..(121): N= Unknown
  misc_feature (127)..(127): N= Unknown
  misc_feature (169)..(174): N= Unknown
  misc_feature (192)..(192): N= Unknown
  misc_feature (243)..(243): N= Unknown
  misc_feature (265)..(265): N= Unknown
  misc_feature (571)..(571): N= Unknown
  misc_feature (683)..(683): N= Unknown
  misc_feature (747)..(747): N= Unknown
  misc_feature (750)..(750): N= Unknown
  misc_feature (753)..(753): N= Unknown
  misc_feature (756)..(756): N= Unknown
  misc_feature (792)..(792): N= Unknown
  misc_feature (905)..(905): N= Unknown
atgatttatcaaagaaacctcatcaaagaactctcttttaccgccgtcggcattttcgtcgtcctcttggcggtattggtctccacgcaggcaatcaacctgctcggccntgccgccgacnggcgtntcgccatcgatgccgtgttggcattggtcggcttctgggtcnnnngnatgacgccgcttttgctngtgttgaccgcatttatcagtacgttgaccgtgttgacccgctactggcgngacagcgaaatgtcggtctggntatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgggttcaacagtttgggcaagcgcaacggcagggtttattttgtcgaaaccttcgataccgaatccggcatcatgaaaaacctgttcctgcgcgaacaggacaaaaacggcggcgacaacatcatcttcnccaaagaaagtaacttctcgctgaacgacaacaaacgcacgctcgaattgcgccacggctaccgttacagcggcacgcccggacgcgccgactacaatcaggtttccttccnaaaactcaacctgattatcagcaccacgcccaaactcatcgaccccgtttcccaccgccgtacnatnccnacngcccaactgattggcagcagcaacccgcaacatcangcggaattgatgtggcgcatctcgctgaccgtcagcgtcctcctactctgcctgcttgccgtgccgctttcctatttcaacccgcgcagcggacatacctacaatatcttgantgccatcggtttgtttttaatttaccaaaacgggctgaccctgctttttgaagccgtggaagacggcaaaatccatttttggctcggactgctgcctatgcacatcatcatgttcgtcatcgcaatcgtacttctgcgcgtccgcagcatgcccagccagcccttctggcaggcggttggcaaaagtctgacattgaaaggcggaaaatga

SEQ ID NO: 502 - protein, 371 aa, Neisseria meningitidis
  misc_feature (37)..(37): Xaa= any amino acid
  misc_feature (41)..(41): Xaa= any amino acid
  misc_feature (43)..(43): Xaa= any amino acid
  misc_feature (57)..(58): Xaa= any amino acid
  misc_feature (89)..(89): Xaa= any amino acid
  misc_feature (191)..(191): Xaa= any amino acid
  misc_feature (228)..(228): Xaa= any amino acid
  misc_feature (250)..(250): Xaa= any amino acid
  misc_feature (264)..(264): Xaa= any amino acid
  misc_feature (302)..(302): Xaa= any amino acid
MIYQRNLIKELSFTAVGIFVVLLAVLVSTQAINLLGXAADXRXAIDAVLALVGFWVXXMTPLLLVLTAFISTLTVLTRYWRDSEMSVWXSCGLALKQWIRPVMQFAVPFAVLVAVMQLWVIPWAELRSREYAEILKQKQELSLVEAGGFNSLGKRNGRVYFVETFDTESGIMKNLFLREQDKNGGDNIIFXKESNFSLNDNKRTLELRHGYRYSGTPGRADYNQVSFXKLNLIISTTPKLIDPVSHRRTXPTAQLIGSSNPQHXAELMWRISLTVSVLLLCLLAVPLSYFNPRSGHTYNILXAIGLFLIYQNGLTLLFEAVEDGKIHFWLGLLPMHIIMFVIAIVLLRVRSMPSQPFWQAVGKSLTLKGGK

SEQ ID NO: 503 - protein, 8 aa, Neisseria meningitidis
NNNNNNNN

SEQ ID NO: 504 - protein, 362 aa, Neisseria gonorrhoeae
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVG

SEQ ID NO: 505 - DNA, 1116 bp, Neisseria gonorrhoeae
atgatttatcaaagaaacctcatcaaagaactctcttttaccgccgtcggcattttcgtcgtcctcttggcggtgttggtgtccacgcaggcgatcaacctgcttggccgcgcagctgacgggcgtgtcgccatcgatgccgtgttggccttagtcggcttctgggtcatcggtatgaccccgcttttgctggtgttgaccgcattcatcagcacgctgaccgtattgacccgctactggcgcgacagcgaaatgtcggtctggctatcctgcggattggcgttgaaacagtggatacgccccgtcatgcagtttgccgtgccgtttgccatcctgattgccgtcatgcagctttgggtgataccgtgggcagagctgcgcagccgcgaatatgccgaaattttgaagcagaagcaggaattgtctttggtggaagccggcgagttcaataacttgggcaagcgcaacggcagggtttatttcgtcgaaacctttgacaccgaatccggcatcatgaaaaacctgttcctgcgcgaacaggacaaaaacggcggcgacaacatcatcttcgccaaagaaggtaacttctcgctgaaggacaacaaacgcacgctcgaattgcgccacggctaccgttacagcggcacgcccggacgcgccgactacaatcaggtttccttccaaaaactcaacctgattatcagcaccacgcccaaacttatcgaccccgtttcccaccgccgcaccatttcgaccgcccaactgattggcagcagcaatccgcaacatcaggcagaattgatgtggcgcatctcgctgaccgtcagcgtcctcctgctctgcctactcgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacatcatcatgttcgtcatcgcaatcgtacttctgcgcgtccgcagtatgcccagccagcccttctggcaggcggttggcaaaagtctgacattgaaaggcggaaaatga

SEQ ID NO: 506 - protein, 371 aa, Neisseria gonorrhoeae
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLKDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVGKSLTLKGGK

SEQ ID NO: 507 - DNA, 407 bp, Neisseria meningitidis
ggtggtggttttatcaatgcttcctgtgccactttgacgacagccaaaccgcaatatcaagcaggagaccttagcgcttttaagataaggcaaggcaatgttgtaatcgccggacacggtttggatgcacgtgataccgattacacacgtattctcagttatcattccaaaatcgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaa

SEQ ID NO: 508 - protein, 135 aa, Neisseria meningitidis
  misc_feature (118)..(118): Xaa= any amino acid
GGGFINASCATLTTAKPQYQAGDLSAFKIRQGNVVIAGHGLDARDTDYTRILSYHSKIDAPVWGQDVRVVAGQNDVAATGDAHSPILNNAAANTSNNTANNGTHIPLFAIDTGKLGGXVCQQNHLDQYGRASRHS

SEQ ID NO: 509 - DNA, 8 bp, Neisseria gonorrhoeae
  misc_feature (1)..(8): N= Unknown
nnnnnnnn

SEQ ID NO: 510 - protein, 263 aa, Neisseria gonorrhoeae; identical to SEQ ID NO: 186

SEQ ID NO: 511 - DNA, 976 bp, Neisseria meningitidis
tcaacgggacatagcgaacaaaattacactttgccgcgagaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttt

SEQ ID NO: 512 - protein, 325 aa, Neisseria meningitidis
STGHSEQNYTLPREITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGV

SEQ ID NO: 513 - DNA, 8 bp, Neisseria gonorrhoeae
  misc_feature (1)..(8): N= Unknown
nnnnnnnn

SEQ ID NO: 514 - protein, 721 aa, Neisseria gonorrhoeae
MLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 515 - DNA, 2166 bp, Neisseria gonorrhoeae
ttgcttgtgcaaacagaaaaagacggtttgcataacgagcaaacctttggcgagaagaaagtcttcagcgaaaatggtaagttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcattaagccgtcatgcgcccagccaaggcactgagttgccacaaagtaaccgggataatatccgtactgcgaaaagcaacggtatttcgctaccctatacgcccaattcttttaccccattacccggcagcagcttatacattatcaatcctgccaataaaggctatcttgttgaaaccgatccacgctttgccaactaccgtcaatggttgggtagtgactatatgctgggcagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagcagcgcaactgaccagcgatattgtttggttggtacaaaaagaagttaaacttcctgatggcggcacacaaaccgtattgatgccacaggtttatgtacgcgttaaaaatggcggcatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcattctttctgccgaacagacattattgctcaatgcgggtaacaacatcaacaaccaaagcacggccaagagcagtcaaaatgcacaaggtagcagcacctacctagaccgaatggcaggtatttatatcacaggcaaagaaaaaggtgttttagcagcgcaggcaggcaaagacatcaacatcattgccggtcaaatcagcaatcaatcagatcaagggcaaacccggctgcaggcaggacgcgacattaacctggatacggtacaaaccggcaaatatcaagaaatccattttgatgccgataaccataccatccgaggttcaacgaacgaagtcggcagcagcattcaaacaaaaggcgatgttaccctattgtcagggaataatctcaatgccaaagctgccgaagtcggcagcgcaaaaggcacacttgccgtgtatgctaaaaatgacattactatcagctcaggcatccatgccggccaagttgatgatgcgtccaaacatacaggcagaagcggcggcggtaataaattagtcattaccgataaagcccaaagtcatcacgaaactgctcaaagcagcacctttgaaggcaagcaagttgtattgcaggcaggaaacgatgccaacatccttggcagtaatgttatttccgataatggcacccggattcaagcaggcaatcatgttcgcattggtacaacccaaactcaaagccaaagcgaaacctatcatcaaacccaaaaatcaggattgatgagtgcaggtatcggcttcactattggcagcaagacaaacacacaagaaaaccaatcccaaagcaacgaacatacaggcagtaccgtaggcagcctgaaaggcgataccaccattgttgcaagcaaacactacgaacaaaccggcagcaacgtttccagccctgagggcaacaaccttatcagcacgcaaagtatggatattggcgcagcacaaaaccaattaaacagcaaaaccacccaaacctacgaacaaaaaggcttaacggtggcattcagttcgcccgttaccgatttggcacaacaagcgattgccgtagcacacaaagcagcaaacaagtcggacaaagcaaaaacgaccgcgttaatgccatggcggctgccaatgcaggttggcaggcctatcaaacaggcaaaggcgcacaaaacttag

SEQ ID NO: 516 - protein, 721 aa, Neisseria gonorrhoeae
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAANKSDKAKTTALMPWRLPMQVGRPIKQAKAHKT

SEQ ID NO: 517 - DNA, 689 bp, Neisseria meningitidis
tcagggaataacctcaatgccaaagctgccgaagtcagcagcgcaaacggtacactcgctgtgtctgccaataatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggctaacggtggcattcagttcgcccgttaccgatttggcacaacaa

SEQ ID NO: 518 - protein, 230 aa, Neisseria meningitidis
  misc_feature (215)..(215): Xaa= any amino acid
SGNNLNAKAAEVSSANGTLAVSANNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKXLTVAFSSPVTDLAQQ

SEQ ID NO: 519 - DNA, 8 bp, Neisseria gonorrhoeae
  misc_feature (1)..(8): N= Unknown
nnnnnnnn

SEQ ID NO: 520 - protein, 721 aa, Neisseria gonorrhoeae
LLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAAKQFDKAKTTALMPWRLPMQVGRLFKQAKAPKK

SEQ ID NO: 521 - DNA, 2166 bp, Neisseria gonorrhoeae; identical to SEQ ID NO: 515

SEQ ID NO: 522 - protein, 721 aa, Neisseria gonorrhoeae; identical to SEQ ID NO: 516

SEQ ID NO: 523 - DNA, 525 bp, Neisseria meningitidis
atgatttacatcgtactgtttctagctgtcgtcctcgccgttgtcgcctacaacatgtatcaggaaaaccaataccgcaaaaaagtgcgcgaccagttcggacactccgacaaagatgccctgctcaacagcawaaccagccatgtccgcgacggcaaaccgtccggcgggtcagtcatgatgccgaaaccccaaccggcggtcaaaaaaacggcaaaaccccaagaccccgycatgcgcaacctgcaagaacaggatgccgtctacatcgccaagcagaaacaggcaaaagcctccccgttcaaaaccgaaatcgaaaccgccttggaagaaagcggcattatcggcaactccgcccacaccgtttccgaaccccaaaccggacattccgcaacgaaacctgccgacgcgtcggcaaaacctgcacccgttccgcaaacacctgcaaaaccgctgattacgctcaaagaactgtcaaaagtcgaattatcctggtttgacgtgcgcatcgacttcatctcctat

SEQ ID NO: 524 - protein, 175 aa, Neisseria meningitidis
  misc_feature (45)..(45): Xaa= any amino acid
  misc_feature (78)..(78): Xaa= any amino acid
MIYIVLFLAVVLAVVAYNMYQENQYRKKVRDQFGHSDKDALLNSXTSHVRDGKPSGGSVMMPKPQPAVKKTAKPQDPXMRNLQEQDAVYIAKQKQAKASPFKTEIETALEESGIIGNSAHTVSEPQTGHSATKPADASAKPAPVPQTPAKPLITLKELSKVELSWFDVRIDFISY

SEQ ID NO: 525 - DNA, 1287 bp, Neisseria meningitidis
atgatttacatcgtactgtttctagctgtcgtcctcgccgttgtcgcctacaacatgtatcaggaaaaccaataccgcaaaaaagtgcgcgaccagttcggacactccgacaaagatgccctgctcaacagcaaaaccagccatgtccgcgacggcaaaccgtccggcgggtcagtcatgatgccgaaaccccaaccggcggtcaaaaaaacggcaaaaccccaagaccccgccatgcgcaacctgcaagaacaggatgccgtctacatcgccaagcagaaacaggcaaaagcctccccgttcaaaaccgaaatcgaaaccgccttggaagaaagcggcattatcggcaactccgcccacaccgtttccgaaccccaaaccggacattccgcaccgaaacctgccgacgcgccggcaaaacctgcacccgttccgcaaacacctgcaaaaccgctgattacgctcaaagaactgtcaaaagtcgaattaccctggtttgacgtgcgcttcgacttcatctcctatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtattcaggcagtcagccgcaacggacttgcctcgcaggaagaactctccgcattcaaccgccaggtggacgcattcgcacaaagcatgggcggtcagacgctgcacaccgaccttgccgcctttatcgaagtggcttccgcactggacgcattctgcgcgcgcgtcgaccagaccatcgccatccatttggtttccccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaacgcccttttggacaaccagtcctacaaaggcttcagtatgctgctcgacatcccgcactctccggcaggcgaaaaaaccttcgacgatttgtttatggatttggcggtacgcctgtccggccagttgaacctgaatctggtcaacgacaaaatggaagaagtttcgacccaatggctcaaagacgtgcgcacttatgtattggcgcgtcagtccgagatgctcaaagtcggtatcgaaccgggcggcaaaaccgcattgcgcctgttctcctaa

SEQ ID NO: 526 - protein, 428 aa, Neisseria meningitidis
MIYIVLFLAVVLAVVAYNMYQENQYRKKVRDQFGHSDKDALLNSKTSHVRDGKPSGGSVMMPKPQPAVKKTAKPQDPAMRNLQEQDAVYIAKQKQAKASPFKTEIETALEESGIIGNSAHTVSEPQTGHSAPKPADAPAKPAPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 527 - DNA, 1287 bp, Neisseria meningitidis
atgatttacatcgtactgttcctcgccgccgtcctcgccgttgtcgcctacaatatgtatcaggaaaaccaataccgcaaaaaagtgcgcgaccagttcgggcactccgacaaagatgccctgctcaacagcaaaaccagccatgtccgcgacggcaaaccgtccggcgggccagtcatgatgccgaaaccccaaccggcggtcaaaaaaacggcaaaatcccaagaccccgccatgcgcaacctgcaagagcaggatgccgtctacatcgccaagcagaaacaggcaaaagcctccccgttcaaaaccgaaatcgaaaccgccttggaagaaagcggcattatcggcaactccgcccacaccgttcccgaaccccaaaccggacattccgcaccaaaacctgccgacgcgccggcaaaacctgttcccgttccgcaaacgccggcaaaaccgctgattacgctcaaagagctgtcgaaggtcgagctgccctggtttgacgtgcgcttcgacttcatctcttatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtattcaggcagtcagccgcaacggacttgcctcgcaggaagaactctccgcattcaaccgccaggtggatgcattcgcacacagcatgggcggtcagacgctgcacaccgaccttgccgcctttatcgaagtggcttccgcactggacgcattctgcgcgcgcgtcgaccagactatcgccatccatttggtttccccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaatgcccttttggacaaccagtcctataaaggcttcagtatgctgctcgacatcccgcactctccggcaggcgaaaaaaccttcgacgatttgtttatggatttggcggtacgcctgtccggccagttgaacctgaatctggtcaacgacaaaatggaagaagtttcgacccaatggctcaaagacgtgcgcacttatgtattggctcgtcagtccgagatgctcaaagtcggtatcgaaccgggcggcaaaaccgcattgcgcctgttctcctaa

SEQ ID NO: 528 - protein, 428 aa, Neisseria meningitidis
MIYIVLFLAAVLAVVAYNMYQENQYRKKVRDQFGHSDKDALLNSKTSHVRDGKPSGGPVMMPKPQPAVKKTAKSQDPAMRNLQEQDAVYIAKQKQAKASPFKTEIETALEESGIIGNSAHTVPEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQVDAFAHSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 529 - DNA, 1287 bp, Neisseria gonorrhoeae
atgatttacatcgtactgttcctcgccgccgtcctcgccgttgtcgcctacaatatgtatcaggaaaaccaataccgcaaaaaagtgcgcgaccagttcggacactccgacaaagatgccctgctcaacagcaaaaccagccatgtccgcgacggcaaaccgtccggcgggccagtcatgatgccgaaaccccaaccggcggtcaaaaaaccggccaaaccccaagactccgccatgcgcaacctgcaagaacaggatgccgtctacatcgccaagcagaaacaggcaaaagcctccccgttcaaaaccgaaatcgaaaccgccttggaagaaatcggcattatcggcaactccgcccacaccgtttccgaaccccaaaccggacattccgcaccgaaacctgccgacgcgccggcaaaacccgttcccgttccgcaaacgccggcaaaaccgctgattacgctcaaagagctgtcgaaggtcgagctgccctggtttgacgtgcgcttcgacttcatctcctatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtatccaggcagtcagccgcaacggacttgcctcgcaggaagaactctccgcattcaaccgccaggcggacgcattcgcacaaagcatgggcggtcagacgctgcacaccgaccttgccgcctttatcgaagtggcttccgcactggacgcattctgcgcgcgcgtcgaccagaccatcgccatccatttggtttcgccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaatgcccttttggacaaccagtcctacaaaggcttcagtatgctgctcgacatcccgcactctccggcaggcgaaaaaaccttcgacgatttgtttatggatttggcggtacgcctgtccggtcagttgaacctgaatctggtcaacgacaaaatggaagaagtttcgacccaatggctcaaagacgtacgcacttatgtattggcgcgtcagtccgagatgctcaaagtcggtatcgaaccgggcggcaaaaccgccctgcgcctgttttcataa

SEQ ID NO: 530 - protein, 428 aa, Neisseria gonorrhoeae
MIYIVLFLAAVLAVVAYNMYQENQYRKKVRDQFGHSDKDALLNSKTSHVRDGKPSGGPVMMPKPQPAVKKPAKPQDSAMRNLQEQDAVYIAKQKQAKASPFKTEIETALEEIGIIGNSAHTVSEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQADAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 531 - DNA, 464 bp, Neisseria meningitidis
gcgcggcacggcacggaagatttcttcatgaacaacagcgacacatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatatttygcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattga

SEQ ID NO: 532 - protein, 154 aa, Neisseria meningitidis
  misc_feature (15)..(15): Xaa= any amino acid
  misc_feature (75)..(75): Xaa= any amino acid
ARHGTEDFFMNNSDXIRQIVESTTGTMKLLISSIALISLVVGGIGVMNIMLVSVTERTKEIGIRMAIGARRGNIXQQFLIEAVLICVIGGLVGVGLSAAVSLVFNHFVTDFPMDISAMSVIGAVACSTGIGIAFGFMPANKAAKLNPIDALAQD

SEQ ID NO: 533 - DNA, 1167 bp, Neisseria meningitidis
atgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattga

SEQ ID NO: 534 - protein, 388 aa, Neisseria meningitidis
MSVQAVLAHKMRSLLTMLGIIIGIASVVSVVALGNGSQKKILEDISSIGTNTISIFPGRGFGDRRSGRIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTQVAEKGLTDLLKARHGTEDFFMNNSDSIRQIVESTTGTMKLLISSIALISLVVGGIGVMNIMLVSVTERTKEIGIRMAIGARRGNILQQFLIEAVLICVIGGLVGVGLSAAVSLVFNHFVTDFPMDISAMSVIGAVACSTGIGIAFGFMPANKAAKLNPIDALAQD

SEQ ID NO: 535 - DNA, 1167 bp, Neisseria meningitidis
atgtcggtgcaagcagtattggcgcacaaaatgcgttcgcttctgacgatgctcggcatcatcatcggtatcgcttcggttgtctccgtcgtcgcattgggcaacggttcgcagaaaaaaatccttgaagacatcagttcgatagggacgaacaccatcagcatcttcccagggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaataccgacctgaccgcttctttgtacggtgtgggcgaacaatatttcgacgtgcgcgggctgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagatgcattggcgcaggattga

SEQ ID NO: 536 - protein, 388 aa, Neisseria meningitidis; identical to SEQ ID NO: 534

SEQ ID NO: 537 - DNA, 1167 bp, Neisseria gonorrhoeae
atgtcggtgcaagcagtattggcgcacaaaatgcgttcgcttctgaccatgctcggcatcatcatcggtatcgcttcggttgtctccgtcgtcgcgctgggcaacggttcgcagaaaaaaatcctcgaagacatcagttcgatggggacgaacaccatcagcatcttccccgggcgcggcttcggcgacaggcgcagcggcaaaatcaaaaccctgaccatagacgacgcaaaaatcatcgccaaacaaagctacgttgcctccgccacgcccatgacttcgagcggcggcacgctgacctaccgcaataccgacctgaccgcttctttgtacggtgtgggcgaacaatatttcgacgtgcgcgggctgaagctggaaacggggcggctgtttgatgagaacgatgtgaaagaagacgcgcaagtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccgggttgccgaaaaagggctggccgagctgctcaaagcacggcacggcacggaagacttctttatgaacaacagcgacagcatcaggcagatggtcgaaagcaccaccggtacgatgaagctgctgatttcctccatcgccctgatttcattggtagtcggcggcatcggtgtgatgaacattatgctggtgtccgttaccgagcgcaccaaagaaatcggcatacggatggcaatcggcgcgcggcgcggcaatattttgcagcagtttttgattgaggcggtgttaatctgcatcatcggaggcttggtcggcgtaggtttgtccgccgccgtcagcctcgtgttcaatcattttgtaaccgatttcccgatggacatttcggcggcatccgttatcggggcggtcgcctgttcgaccggaatcggcatcgcgttcggctttatgcctgccaataaggcagccaaactcaatccgatagatgcattggcgcaggattga

SEQ ID NO: 538 - protein, 388 aa, Neisseria gonorrhoeae
MSVQAVLAHKMRSLLTMLGIIIGIASVVSVVALGNGSQKKILEDISSMGTNTISIFPGRGFGDRRSGKIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTRVAEKGLAELLKARHGTEDFFMNNSDSIRQMVESTTGTMKLLISSIALISLVVGGIGVMNIMLVSVTERTKEIGIRMAIGARRGNILQQFLIEAVLICIIGGLVGVGLSAAVSLVFNHFVTDFPMDISAASVIGAVACSTGIGIAFGFMPANKAAKLNPIDALAQD

SEQ ID NO: 539 - DNA, 606 bp, Neisseria meningitidis
gggacgggagcgatgctgctgctgttttacgcggtaacgatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttga

SEQ ID NO: 540 - protein, 201 aa, Neisseria meningitidis
GTGAMLLLFYAVTILPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIISAVF

SEQ ID NO: 541 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataa

SEQ ID NO: 542 - protein, 300 aa, Neisseria meningitidis
  misc_feature (64)..(64): Xaa= any amino acid
MDTAKKDILGSGWMLVAAACFTIMNVLIKEASAKFALGSGELVFWRMLFSTVALGAAAVLRRDXFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 543 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcatcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctggccgaagagcttttctggcaggaaatactcggtatgtgcatcatcatcctcagcggtattttgagcagcatccgccccactgccttcaaacagcggctgcaatccctgttccgccaaagataa

SEQ ID NO: 544 - protein, 300 aa, Neisseria meningitidis
MDTAKKDILGSGWMLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLAEELFWQEILGMCIIILSGILSSIRPTAFKQRLQSLFRQR

SEQ ID NO: 545 - DNA, 8 bp, Neisseria gonorrhoeae
  misc_feature (1)..(8): N= Unknown
nnnnnnnn

SEQ ID NO: 546 - protein, 506 aa, Neisseria gonorrhoeae
MPSEKAFRRHLRTASFQGLHLHHFHQKVGKCGIIGFGIHIFPTLLPAAQGILDIQLGLFRIDFAALAVYRRTQVDFIHTVIDGIASDQAFSEVVQILRRLNLGHFTDTHLIAQARRFIADFGNIRPMRRGEAKTFCRCFRFDGIDGIHGDFRQCGHINRLAPGKDCRNGKRDKVFFHTRHYNQVCLEKTNCSARKIKFRHQKQAKTHSTSLAARFTIRPSLSQRPFMDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIISAAF

SEQ ID NO: 547 - DNA, 903 bp, Neisseria gonorrhoeae
atggataccgcaaaaaaagacattttaggatcgggctggatgctggtggcggcggcctgcttcaccgttatgaacgtattgattaaagaggcatcggcaaaatttgccctcggcagcggcgaattggtcttttggcgcatgctgttttcaaccgttacgctcggtgctgccgccgtattgcggcgcgacaccttccgcacgccccattggaaaaaccacttaaaccgcagtatggtcgggacgggggcgatgctgctgctgttttacgcggtaacgcatctgcctttgacaaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaccggcggcactcgccgggctggcgggcggcgcgatgtccggctgggcgtatttgaaagtgcgcgaactgtctttggcgggcgaacccggctggcgcgtcgtgttttacctttccgcaaccggcgtggcgatgtcgtcggtttgggcgacgctgaccggctggcacaccctgtcctttccatcggcagtttatctgtcgggcatcggcgtgtccgcgctgattgcccaactgtcgatgacgcgcgcctacaaagtcggcgacaaattcacggttgcctcgctttcctatatgaccgtcgtcttttccgccctgtctgccgcattttttctgggcgaagagcttttctggcaggaaatactcggtatgtgcatcattatcctcagcggcattttgagcagcatccgccccattgccttcaaacagcggctgcaagccctcttccgccaaagataa

SEQ ID NO: 548 - protein, 300 aa, Neisseria gonorrhoeae
MDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 549 - DNA, 706 bp, Neisseria meningitidis
atgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccsggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcatatctgctcctcaacgtgtacggtatctgtttgcaccttactgcggctttctgccktcggcatccgattcggatttgaaaagttcmmrwyattcggaatag

SEQ ID NO: 550 - protein, 234 aa, Neisseria meningitidis
  misc_feature (115)..(115): Xaa= any amino acid
  misc_feature (231)..(232): Xaa= any amino acid
MKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAXFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSXXSE

SEQ ID NO: 551 - DNA, 708 bp, Neisseria meningitidis
atgatgaagcggcgtatagccgtcttcgtcctgttcccgcagataatccgagttttgggacaactgttgccgaaaatcgtcaatacagttccggcacatcggatgctcttccagattttcgggatgttctttttcttcatacaccagcaatatctgcccgggatcgccgaaatcgattccccatgcggcatcgtgttcggtgcgctcctcttccgtcatctgcccgcgcattgcctgtatggtaaagccgccgtaggggatgccgttgcacacgaacatccagtcgctgatgtcgtcaaccggaacgcaaacgctttcgccttgttcgacattggtcagttcgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaaatatttgaatgttttacgggcgcgttcgtcggcacggtttaccggttcgtctgcctgttctacataataaatgacggaatcgcccatcattctgctcctcaacgtgtacggtatctgtttgcaccttactgcggctttctgccttcggcatccgattcggatttgaaaagttccaaatattcggaatag

SEQ ID NO: 552 - protein, 235 aa, Neisseria meningitidis
MMKRRIAVFVLFPQIIRVLGQLLPKIVNTVPAHRMLFQIFGMFFFFIHQQYLPGIAEIDSPCGIVFGALLFRHLPAHCLYGKAAVGDAVAHEHPVADVVNRNANAFALFDIGQFAGFIVQHTVNIKTVKINIVDPHMFANFAVFAVLEKRDFDHGKIQGGNNAAAFPKKLAPKIFECFTGAFVGTVYRFVCLFYIINDGIAHHSAPQRVRYLFAPYCGFLPSASDSDLKSSKYSE

SEQ ID NO: 553 - DNA, 708 bp, Neisseria meningitidis
  misc_feature (117)..(117): N= Unknown
  misc_feature (221)..(221): N= Unknown
  misc_feature (427)..(427): N= Unknown
  misc_feature (476)..(476): N= Unknown
  misc_feature (478)..(479): N= Unknown
  misc_feature (481)..(482): N= Unknown
atgatgaagcggcgtatagccgtcttcgtcctgctcatgcagaaaatccggattttgggacaactgttgccgaaaatcgtcaatacagttccggcacatcggatgctcttccagatnttcgggatgttctttttcttcatacaccagcaatacctgcccgggatcgccgaaatcgattccccatgcggcatcgtgttcggtacgctcctcttccgtcatcngtccacgcattgcctgtatggtaaagccgccgtagggaatgccgttgcacacgaacatccagtcgctgatgtcgtcaaccggaacgcaaacgctttcgccttgttcgacattggtcagttcgccgggttcattgttcagcacgccataaatgtaaagaccgtcaaaataaatatcgtcgatccacatatgttcgcaaatttcgccntcttcgccgtcttggaaaaaagggctttgaccatggcaaaatctaaggngnnanngatgcggcggcgttcccaaaaaagctcgcgccaaaaatatttgaatgttttgcgggcgcgttcgccggcacggtttaccggtttgtctgcctgttctacataataaatgacggaatcgcccatcatatctgctcctcaacgtgtacggtatctgtttgcaccttactgcggctttctgccttcggcatccgattcggatttgaaaagttccaaatattcggaatag

SEQ ID NO: 554 - protein, 233 aa, Neisseria meningitidis
  misc_feature (39)..(39): Xaa= any amino acid
  misc_feature (74)..(74): Xaa= any amino acid
  misc_feature (143)..(143): Xaa= any amino acid
  misc_feature (159)..(161): Xaa= any amino acid
MMKRRIAVFVLLMQKIRILGQLLPKIVNTVPAHRMLFQXFGMFFFFIHQQYLPGIAEIDSPCGIVFGTLLFRHXSTHCLYGKAAVGNAVAHEHPVADVVNRNANAFALFDIGQFAGFIVQHAINVKTVKINIVDPHMFANFAXFAVLEKRALTMAKSKXXXMRRRSQKSSRQKYLNVLRARSPARFTGLSACSTMTESPIISAPQRVRYLFAPYCGFLPSASDSDLKSSKYSE

SEQ ID NO: 555 - DNA, 708 bp, Neisseria gonorrhoeae
atgatgaagcggcgtatagccgtcttcgtcctgctcatgcagaaaatccggattttgggacaactgttgccgaaaatcgtcaatacagttccggcacatcggatgctcttccaaattttcgggatgttctttttcttcatacaccggcaatacctgcccgggatcgccgaaatcgattccccaggcggtatcgtgttcggtacgctcctcttccgtcatctgtccgcgcattgcctgtacggtaaagccgccgtaggggatgccgttgcacacgaacatccagtcgctgatgtcgccaaccggaacgcaaacgctttcgccttgttcgacattggtcagtccgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaagtatttgaatgttttacgggcgcgttcgccggcacggtttaccggttcgtctgcctgttctacataataaatgacggaatcgcccatcatactgctcctcaacgtgtacggtatctgtttgcaccttaccgcggttttctacctccggcatccgattcggatttgaaaagttccaaatattcggaatag

SEQ ID NO: 556 - protein, 235 aa, Neisseria gonorrhoeae
MMKRRIAVFVLLMQKIRILGQLLPKIVNTVPAHRMLFQIFGMFFFFIHRQYLPGIAEIDSPGGIVFGTLLFRHLSAHCLYGKAAVGDAVAHEHPVADVANRNANAFALFDIGQSAGFIVQHTVNIKTVKINIVDPHMFANFAVFAVLEKRDFDHGKIQGGNNAAAFPKKLAPKVFECFTGAFAGTVYRFVCLFYIINDGIAHHTAPQRVRYLFAPYRGFLPPASDSDLKSSKYSE

SEQ ID NO: 557 - DNA, 446 bp, Neisseria meningitidis
atggaaaatatggtaacgttttcaaaaatcagaccgcttttggcaatcgccgccgccgcgttgcttgccgcctgcggacggcgggaaataatgctgtccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacctccgcaggttcgattgtcggcaacctttttgcatcgggtatgtcgcccgaccgcctcgaattggaagccgaaattttaggcaaaaccgatttggtcgatttaaccttgtccaccaatgggtttatcaaaggcgcaaagctgcaaaattacatcaaccgaaaactccgcggcatgcagattcagcagtttcccatcaaatttgccgcc

SEQ ID NO: 558 - protein, 149 aa, Neisseria meningitidis
  misc_feature (25)..(25): Xaa= any amino acid
MENMVTFSKIRPLLAIAAAALLAAXRTAGNNAVRKPVQTAKPAAVVGLALGGGASKGFAHVGIIKVLKENGIPVKVVTGTSAGSIVGNLFASGMSPDRLELEAEILGKTDLVDLTLSTNGFIKGAKLQNYINRKLRGMQIQQFPIKFAA

SEQ ID NO: 559 - DNA, 903 bp, Neisseria meningitidis
atggaaaatatggtaacgttttcaaaaatcagaccgcttttggcaatcgccgccgccgcgttgcttgccgcctgcggcacggcgggaaataatgctgtccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacatcggcaggttcgattgtcggcagcctttttgcatcgggtatgtcgcccgaccgcctcgaattggaagccgaaattttaggcaaaaccgatttggtcgatttaaccttgtccaccagtggttttatcaaaggcgaaaagctgcaaaattacatcaaccgaaaagtcggcggcaggcagattcagcagtttcccatcaaatttgccgccgttgctactgattttgaaaccggcaaggccgtcgctttcaatcaggggaatgccgggcaggctgtgcgcgcttccgccgccattcccaatgtgttccaacccgttatcatcggcaggcatacatatgttgacggcggtctgtcgcagcccgtgcccgtcagtgccgcccggcggcagggggcgaatttcgtgattgccgtcgatatttccgcccgtccgggcaaaaacatcagccaaggtttcttctcttatctcgatcagacgctgaacgtaatgagcgtttctgcgttgcaaaatgagttggggcaggcggatgtggttatcaaaccgcaggttttggatttgggtgcagtcggcggattcgatcagaaaaaacgcgccatccggttgggtgaggaggcagcacgtgccgcattgcctgaaatcaaacgcaaactggcggcataccgttattga

SEQ ID NO: 560 - protein, 300 aa, Neisseria meningitidis
MENMVTFSKIRPLLAIAAAALLAACGTAGNNAVRKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHTYVDGGLSQPVPVSAARRQGANFVIAVDISARPGKNISQGFFSYLDQTLNVMSVSALQNELGQADVVIKPQVLDLGAVGGFDQKKRAIRLGEEAARAALPEIKRKLAAYRY

SEQ ID NO: 561 - DNA, 903 bp, Neisseria meningitidis
  misc_feature (624)..(624): N= Unknown
  misc_feature (626)..(629): N= Unknown
  misc_feature (631)..(631): Xaa= any amino acid
  misc_feature (634)..(634): Xaa= any amino acid
atggaaaatatggtaacgttttcaaaaatcagaccgcttttggcaatcgccgccgccgcgttgcttgccgcctgcggcacggcgggaaataatgctgcccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacatcggcaggttcgatagtcggcagcctttttgcatcgggtatgtcgcccgaccgcctcgaattggaagccgaaattttaggtaaaaccgatttggtcgatttaaccttgtccaccagtggttttatcaaaggcgaaaagctgcaaaattacatcaaccgaaaagtcggcggcaggcggattcagcagtttcccatcaaatttgccgccgttgctactgattttgaaaccggcaaggccgtcgctttcaatcaagggaatgccgggcaggctgtgcgcgcttccgccgccattcccaatgtgttccaacccgttatcatcggcaggcatacatatgttgacggcggtctgtcgcagcccgtgcccgtcagtgccgcccggcggcangnnnngnatntcgtgattgccgtcgatatttccgcccgtccgagcaaaaacatcagccaaggcttcttctcttatctcgatcagacgctgaacgtaatgagcgtttccgcgttgcaaaatgagttggggcaggcggatgtggttatcaaaccgcaggttttggatttgggtgcagtcggcggattcgatcagaaaaaacgcgccatccggttgggtgaggaggcagcacgtgccgcattgcctgaaatcaaacgcaaactggcggcataccgttattga

SEQ ID NO: 562 - protein, 300 aa, Neisseria meningitidis
  misc_feature (208)..(212): Xaa= any amino acid
MENMVTFSKIRPLLAIAAAALLAACGTAGNNAARKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRRIQQFPIKFAAVATDFETGKAVAFNQGNAGQAVRASAAIPNVFQPVIIGRHTYVDGGLSQPVPVSAARRXXXXXVIAVDISARPSKNISQGFFSYLDQTLNVMSVSALQNELGQADVVIKPQVLDLGAVGGFDQKKRAIRLGEEAARAALPEIKRKLAAYRY

SEQ ID NO: 563 - DNA, 903 bp, Neisseria gonorrhoeae
atggaaaatatggtaacgttttcaaaaatcagatcatttttggcaatcgccgccgccgcgttgcttgccgcctgcggtacggcgggaaacaatgccgcccgcaagccggtgcaaaccgccaaacccgccgcagtggtcgctttggcactcggtggcggcgcatctaaaggatttgcccatataggaattgttaaggttttgaaagaaaacggtattcctgtgaaggtggttaccggcacatcggcaggttcgatagtcggcagccttttggcatcgggtatgtcgcccgaccgcctcgaattggaagccgagattttaggtaaaaccgatttagtcgatttaaccttgtccaccagtggttttatcaaaggcgaaaagctgcaaaattacatcaaccgaaaagtcggcggcaggcagattcagcagtttcccatcaaatttgccgccgttgccactgattttgaaaccggcaaggccgtcgctttcaatcaagggaatgccgggcaggcggttcgtgcttccgccgccattcccaatgtgttccagccagtcatcatcggcaggcacaaatatgttgacggcggtctgtcgcagcccgtgcccgtcagtgccgctcggcggcagggggcgaatttcgtgattgccgtcgatatttccgcacgtccgagcaaaaatgtcggtcaaggtttcttctcttatctcgatcagacgctgaacgtgatgagcgtttccgtgttgcaaaacgagttggggcaggcggatgtggttatcaaaccgcaggttttggatttgggtgcagtcggcggattcgatcagaaaaagcgcgccatccggttgggcgaggaggcagcacgtgccgcattgcctgaaatcaaacgcaaactggcggcataccgttattga

SEQ ID NO: 564 - protein, 300 aa, Neisseria gonorrhoeae
MENMVTFSKIRSFLAIAAAALLAACGTAGNNAARKPVQTAKPAAVVALALGGGASKGFAHIGIVKVLKENGIPVKVVTGTSAGSIVGSLLASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHKYVDGGLSQPVPVSAARRQGANFVIAVDISARPSKNVGQGFFSYLDQTLNVMSVSVLQNELGQADVVIKPQVLDLGAVGGFDQKKRAIRLGEEAARAALPEIKRKLAAYRY

SEQ ID NO: 565 - DNA, 369 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccmatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattc

SEQ ID NO: 566 - protein, 123 aa, Neisseria meningitidis
  misc_feature (60)..(60): Xaa= any amino acid
MFRLQFRLFPPLRTAMHILLTALLKCLSLLPLSCLHTLGNRLGHLAFYLLKEDRARIVAXMRQAGLNPDPKTVKAVFAETAKGGLELAPAFFRKPEDIETMFKAVHGWEHVQQALDKHEGLLF

SEQ ID NO: 567 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 568 - protein, 298 aa, Neisseria meningitidis
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 569 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcgtcaggcaggcatgaatcccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 570 - protein, 298 aa, Neisseria meningitidis; identical to SEQ ID NO: 568

SEQ ID NO: 571 - DNA, 894 bp, Neisseria gonorrhoeae
atgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccgtaa

SEQ ID NO: 572 - protein, 297 aa, Neisseria gonorrhoeae
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 573 - DNA, 567 bp, Neisseria meningitidis
gcgtggtcggccggcgaatcgtggcgtgtgttaatggaaagtgaaacgtggcatgcggtgtggaatactttgcgcttctcggcggcggcggtgtatgcggcagcggttttgggtgtggtgtatgcggcgccggcgcggcggtcggcgtggatgcgcgggctgatgttttagccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctg

SEQ ID NO: 574 - protein, 189 aa, Neisseria meningitidis
  misc_feature (57)..(57): Xaa= any amino acid
AWSAGESWRVLMESETWHAVWNTLRFSAAAVYAAAVLGVVYAAPARRSAWMRGLMFXPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVL

SEQ ID NO: 575 - DNA, 1542 bp, Neisseria meningitidis
atggatggacggcgttgggtggtatggggtgcttttgccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggccctgttcggggcggacgggctgttgtggcgcggcaggcaggatacgccgtatctgttgttgtacggcaatgtgtttttcaaccttcctgtgttggtcagggcggcgtatcaggggtttgtgcaagtgcctgcggcacggcttcagacggcacggacgttgggcgcgggggcgtggcggcggttttgggacattgaaatgcccgttttgcgcccgtggcttgccggcggcgtgtgccttgtctttctgtattgtttttccgggttcgggctggcgctgctgctgggcggcagccgttatgccacggtcgaagtggaaatttaccagttggtcatgttcgaactcgatatggcggttgcttcggtgctggtgtggctggtgttgggggtaacggcggcggcagggttgctgtatgcgtggttcggcaggcgcgcggtttcggataaggcggtttcccctgtgatgccgtcgccgccgcagtcggtcggggaatatgtgctgctggcgtttgcggcggcggtgttgtctgtgtgctgcctgtttcctttgttggcaattgttgtgaaagcgtggtcggccggcgaatcgtggcgtgtgttaatggaaagtgaaacgtggcaggcggtgtggaatactttgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctgacattgctgttggcggcgttcgcgctgggtattttcctgctgttggacggcggcgaaggcggaaaacagacggaaacgttataa

SEQ ID NO: 576 - protein, 513 aa, Neisseria meningitidis
MDGRRWVVWGAFALLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFVQVPAARLQTARTLGAGAWRRFWDIEMPVLRPWLAGGVCLVFLYCFSGFGLALLLGGSRYATVEVEIYQLVMFELDMAVASVLVWLVLGVTAAAGLLYAWFGRRAVSDKAVSPVMPSPPQSVGEYVLLAFAAAVLSVCCLFPLLAIVVKAWSAGESWRVLMESETWQAVWNTLRFSAAAVYAAAVLGVVYAAAARRSAWMRGLMFLPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLAAFALGIFLLLDGGEGGKQTETL

SEQ ID NO: 577 - DNA, 1542 bp, Neisseria meningitidis
  misc_feature (350)..(350): N= Unknown
  misc_feature (406)..(406): N= Unknown
  misc_feature (479)..(479): N= Unknown
  misc_feature (693)..(693): N= Unknown
  misc_feature (707)..(707): N= Unknown
  misc_feature (717)..(717): N= Unknown
  misc_feature (774)..(774): N= Unknown
  misc_feature (825)..(825): N= Unknown
  misc_feature (848)..(848): N= Unknown
  misc_feature (869)..(869): N= Unknown
  misc_feature (961)..(961): N= Unknown
  misc_feature (1111)..(1111): N= Unknown
  misc_feature (1203)..(1203): N= Unknown
  misc_feature (1366)..(1366): N= Unknown
  misc_feature (1376)..(1376): N= Unknown
  misc_feature (1414)..(1414): N= Unknown
  misc_feature (1431)..(1431): N= Unknown
  misc_feature (1491)..(1491): N= Unknown
atggatggacggcgttgggcggtatggggtgcttttgccctgctgccttcggcttttttggcggcaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggctctgttcggggcggacggcctgtngtggcgcggctggcaggatacgccgtatctgttgttgtacggcaatgtgttttttnaccttcctgtgttggtcagggcggcatatcaggggtttgtgcaagtgcctgcggcacggcttcagacggcacngacattgggcgcgggggcgtggcggcggttttgggacattgaaatgcccgttttgcgcccgtggcttgccggcggcgtgtgccttgtcttcctgtattgtttttcggggttcgggctggcattgctgctgggcggcagccgttatgccacggtcgaagtggaaatttaccagttggtcatgttcgaactcgatatggcggttgcttcggtgctngtgtggctggtgtngggggtaacngcggcggcagggttgctgtatgcgtggttcggcaggcgcgcggtttcggataaggcngtttcccctgtgatgccgtcgccgccgcagtcggtcggggaatatgtgctnctggcgtttgcggcggcggtgtngtctgtgtgctgcctgtttcntttgttggcaattgttgtgaaagcgtggtcggccggcgaatcgtggcgtgtgttaatggaaagtgaaacgtggcaggcggtgtggaatactntgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgcttnatccgcagtggacggcttcgttgccgctgctgctggcgatgtatgcgctgctggcgtatccgtttgtggcaaaagatgttttatcagcctgngatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcaaccttgttcntgtcgcgtcncgagtggcagacgctgacgactttgatttatgcctatntgggacgcgcgggtgangataattacgcgcgggcgatggtgctgacattgctgttggcggcgttcgcgctgggtatnttcctgctgttggacggcggcgaaggcggaaaacggacggaaacgttataa

SEQ ID NO: 578 - protein, 513 aa, Neisseria meningitidis
  misc_feature (117)..(117): Xaa= any amino acid
  misc_feature (136)..(136): Xaa= any amino acid
  misc_feature (160)..(160): Xaa= any amino acid
  misc_feature (236)..(236): Xaa= any amino acid
  misc_feature (283)..(283): Xaa= any amino acid
  misc_feature (290)..(290): Xaa= any amino acid
  misc_feature (321)..(321): Xaa= any amino acid
  misc_feature (371)..(371): Xaa= any amino acid
  misc_feature (401)..(401): Xaa= any amino acid
  misc_feature (456)..(456): Xaa= any amino acid
  misc_feature (459)..(459): Xaa= any amino acid
  misc_feature (472)..(472): Xaa= any amino acid
  misc_feature (477)..(477): Xaa= any amino acid
  misc_feature (497)..(497): Xaa= any amino acid
MDGRRWAVWGAFALLPSAFLAAMVVAPLWAVAAYDGLAWRAVLSDAYMLKRLAWTVFQAAATCVLVLPLGVPVAWVLARLAFPGRALVLRLLMLPFVMPTLVAGVGVLALFGADGLXWRGWQDTPYLLLYGNVFFXLPVLVRAAYQGFVQVPAARLQTAXTLGAGAWRRFWDIEMPVLRPWLAGGVCLVFLYCFSGFGLALLLGGSRYATVEVEIYQLVMFELDMAVASVLVWLVXGVTAAAGLLYAWFGRRAVSDKAVSPVMPSPPQSVGEYVLLAFAAAVXSVCCLFXLLAIVVKAWSAGESWRVLMESETWQAVWNTXRFSAAAVYAAAVLGVVYAAAARRSAWMRGLMFLPFMVSPVCVSAGVLLLXPQWTASLPLLLAMYALLAYPFVAKDVLSAXDALPPDYGRAAAGLGANGFQTACRITFPLLKPALRRGLTLAAATCVGEFAATLFXSRXEWQTLTTLIYAYXGRAGXDNYARAMVLTLLLAAFALGXFLLLDGGEGGKRTETL

SEQ ID NO: 579 - DNA, 8 bp, Neisseria gonorrhoeae
  misc_feature (1)..(8): N= Unknown
nnnnnnnn

SEQ ID NO: 580 - protein, 513 aa, Neisseria gonorrhoeae
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRPFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 581 - DNA, 1542 bp, Neisseria gonorrhoeae
atggatggacggtgttgggcggtacggggtgctttttccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtgtttcaggcggcggcaacctgtgtgctggtgctgcctttgggcgtgcctgtcgcgtgggtgctggcgcggctggcgttcccggggcgggctttggtgctgcgcctgctgatgctgccgtttgtgatgcccacgctggtggcgggcgtgggcgtgctggctctgttcggggcggacgggctgttgtggcgcggccggcaggatacgccgtatctgttgttgtacggcaatgtgtttttcaacctgcccgtgttggtcagggcggcgtatcaggggtttgctcaagtgcctgcggcacggcttcagacggcacggacgttgggcgcgggggcgtggcggcggttttgggacattgaaatgcccgttttgcgcccgtggcttgccggcggcgtgtgccttgtcttcctgtattgtttttcggggttcgggctggcattgctgttgggcggcagccgttatgccacggtcgaagtggaaatttaccagttggttatgttcgaactcgatatggcgggggcttcggcgctggtgtggctggtgttgggggtaacggcggcggcagggttgctgtatgcgtggttcggcaggcgcgcggtttcggataaggcggtttcccccgtgatgccgtcgccgccgcaatcggtgggggaatatgtattgctggcattttcggtggcggtgttgtccgtgtgctgcctgtttcctttgtcggcaattgttgtgaaagcgtggtcggccggcgaatcgcggcgtgtgttaatggaaagtgaaacgtggcaggcagtgtggaatactttgcgcttttcggcggcggcggtgtttgcggcggcggttttgggtgtggtgtatgcggcggcggcgcggcggctggtgtggatgcgcggactggtgtttttaccgtttatggtgtcgccggtttgtgtttcggcgggcgtgctgctgctttatccggggtggacggcttcgttaccgctgctgctggcgatgtatgcgctgctggcgtatccgtttgtggcaaaagatgttttatcggcctgggatgcactgccgccggattacggcagggcggcggcaggtttgggcgcaaacggctttcagacggcatgccgtatcacgttccccctcttgaaaccggcgttgcggcgcggtctgactttggcggcggcgacgtgtgtgggcgaatttgcggcaaccttgttcctgtcgcgtccggaatggcagacgttgacgactttgatttatgcctatttggggcgtgcgggtgaggacaattatgcgcgggcaatggtgttgacattgctgttgtcggcatttgcggtgtgcattttcctgctgttggacaacggcgaaggcggaaaacggacggaaacgttataa

SEQ ID NO: 582 - protein, 513 aa, Neisseria gonorrhoeae
MDGRCWAVRGAFSLLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRRFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 583 - DNA, 261 bp, Neisseria meningitidis
atggacggctggacacagacgctgtccgcgcaaaccctgttgggcatttcggcggcggcaatcatcctcattctgattttaatcgtcagattccgcatccacgcgctgctgacactggtcatcgtcagcctgctgacggctttggcaaccggtttgcccacaggcagcattgtcaaagacatactggtcaaaaacttcggcggcacgctcggcggcgtggcgcttctggtcggcctgggcgcgatgctcgaacgtttggtc

SEQ ID NO: 584 - protein, 87 aa, Neisseria meningitidis
MDGWTQTLSAQTLLGISAAAIILILILIVRFRIHALLTLVIVSLLTALATGLPTGSIVKDILVKNFGGTLGGVALLVGLGAMLERLV

SEQ ID NO: 585 - DNA, 1386 bp, Neisseria meningitidis
atggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacatactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctga

SEQ ID NO: 586 - protein, 461 aa, Neisseria meningitidis
MDGWTQTLSAQTLLGISAAAIILILILIVKFRIHALLTLVIVSLLTALATGLPTGSIVNDILVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 587 - DNA, 1386 bp, Neisseria meningitidis
atggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacgtactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggacatggacgtaccgaccacgctgaaaacctggacggtcaaccaaaccctcatcgcactcatcggctttgccttgtccgcactgctgttcgccatcgtctga

SEQ ID NO: 588 - protein, 461 aa, Neisseria meningitidis
MDGWTQTLSAQTLLGISAAAIILILILIVKFRIHALLTLVIVSLLTALATGLPTGSIVNDVLVKNFGGTLGGVALLVGLGAMLGRLVETSGGAQSLADALIRMFGEKRAPFALGVASLIFGFPIFFDAGLIVMLPIVFATARRMKQDVLPFALASIGAFSVMHVFLPPHPGPIAASEFYGANIGQVLILGLPTAFITWYFSGYMLGKVLGRTIHVPVPELLSGGTQDNDLPKEPAKAGTVVAIMLIPMLLIFLNTGVSALISEKLVSADETWVQTAKIIGSTPIALLISVLVALFVLGRKRGESGSALEKTVDGALAPVCSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIALIGFALSALLFAIV

SEQ ID NO: 589 - DNA, 8 bp, Neisseria gonorrhoeae
  misc_feature (1)..(8): N= Unknown
nnnnnnnn

SEQ ID NO: 590 - protein, 461 aa, Neisseria gonorrhoeae
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLSDMDVPTTLKTWTVNQTLIAFIGFALSALLFAIV

SEQ ID NO: 591 - DNA, 1386 bp, Neisseria gonorrhoeae
atggacggccggacacagacgctgtccgcgcaaaccttgttgggcatttcggcggcggcaatcatcctcattctgattttaatcgtcaaattccgcatccgcgcgctgctgacactggtcatcgccagcctgctgacggctttggcaaccggtttgcccacaggcagcatcgtcaacgacgtactggtcaaaaacttcggcggcacgctcggcggcgtggcgcttctggtcggtctgggcgcaatgctcggacgtttggtagaaacatccggcggcgcacagtcgctggcggacgcgctgatccggatgttcggcgaaaaacgcgcaccgttcgctccgggcgttgcctcgctgattttcggcttcccgattttcttcgatgccggactaatcgtcatgctgcccatcgtattcgccaccgcacggcgcatgaaacaggacgtactgcccttcgcgcttgcctccgtcggcgcattttccgtcatgcacgtcttcctgccgccccatccgggcccgattgccgcttccgaattttacggcgcgaacatcggccaggttttgattttgggtctgccgaccgccttcatcacatggtatttcagcggctatatgctcggcaaagtgttggggcgcgccatccatgttcccgttcccgaactgctcagcggcggcacgcaagacagcgacccgccgaaagaacctgccaaagcaggaacggtcgtcgccgtcatgctgattcccatgctgctgattttcctgaataccggcgtatcagccctcatcagcgaaaaactcgtaagtgcggacgaaacttgggttcagacggcaaaaatgatcggttcgacacctgtcgcccttctgatttccgtattggccgcactgttggtcttgggacgcaaacgcggcgaaagcggcagcacgttggaaaaaaccgtggacggcgcactcgcccccgcctgttccgtgattctgattaccggcgcgggcggtatgttcggcggcgttttgcgcgcttccggcatcggcaaggcactcgccgacagcatggcggatttgggcattcccgtccttttgggctgcttccttgtcgccttggcactgcgtatcgcgcaaggttcggcaaccgtcgccctgaccacagccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggatatggacgtaccgaccacgctgaaaacctggacggtcaaccaaaccctcatcgcattcatcggctttgccttgtccgcactgctgtttgccatcgtctga

SEQ ID NO: 592 - protein, 461 aa, Neisseria gonorrhoeae
MDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIAFIGFALSALLFAIV

SEQ ID NO: 593 - DNA, 419 bp, Neisseria meningitidis
gatttcggcatatcgcccgtgtatctttgggttgccgccgcgttcaaacatttgctgtcgccgtgggctgccgactcatacgatgtcgcacgctttgcaggcgtattttttgccgttatcggactgacttcctgcggctttgccggtttcaactttttgggcagacaccacgggcgcacgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccg

SEQ ID NO: 594 - protein, 140 aa, Neisseria meningitidis
  misc_feature (60)..(60): Xaa= any amino acid
DFGISPVYLWVAAAFKHLLSPWAADSYDVARFAGVFFAVIGLTSCGFAGFNFLGRHHGRXVVLILIGCIGLIPVAHFLNPAAAAFAAAGLVLHGYSLARRRVIAASFLLGTGWTLMSLAAAYPAAFALMLPLPVLMFFRP

SEQ ID NO: 595 - DNA, 1662 bp, Neisseria meningitidis
atgctgacctataccccgcccgatgcccgcccgcccgccaaaacccacgaaaagccgtggctgctgctgttgatggcgtttgcctggttgtggcccggcgtgttttcccacgatttgtggaatcctgacgaacctgccgtctataccgccgtcgaagcactggcaggcagccccacccccttggttgcccatctgttcggtcaaaccgatttcggcataccgcccgtgtatctttgggttgccgccgcgttcaaacatttgctgtcgccgtgggctgccgactcatacgatgccgcacgctttgcaggcgtattttttgccgttatcggactgacttcctgcggctttgccggtttcaactttttgggcagacaccacgggcgcagcgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccgtggcaaagcaggcgtttgatgttgacggcagtcgcctcacttgcctttgccctgccgcttatgaccgtttacccgctgctcttggcaaaaacgcagcccgcgctgttcgcgcaatggctcgactatcacgttttcggtacgttcggcggcgtgcggcacgttcagacggcattcagtttgttttactatctgaaaaacctgctttggtttgcattgcccgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgaggcgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgccggtcgtccggagtatggaggcatcgctttccccggaattgaaacgggagctttcagacggcatcgagtgtatcggcataggcggcggcgacctgcacacgcggattgtttggacgcagtacggcacattgccgcaccgcgtcggcgatgtacaatgccgctaccgcatcgtcctcctgccccaaaatgcggatgcgccgcaaggctggcagacggtttggcagggtgcgcgtccgcgcaacaaagacagtaagttcgcactgatacggaaaatcggggaaaatatataa

SEQ ID NO: 596 - protein, 553 aa, Neisseria meningitidis
MLTYTPPDARPPAKTHEKPWLLLLMAFAWLWPGVFSHDLWNPDEPAVYTAVEALAGSPTPLVAHLFGQTDFGIPPVYLWVAAAFKHLLSPWAADSYDAARFAGVFFAVIGLTSCGFAGFNFLGRHHGRSVVLILIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDYHVFGTFGGVRHVQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIGIGGGDLHTRIVWTQYGTLPHRVGDVQCRYRIVLLPQNADAPQGWQTVWQGARPRNKDSKFALIRKIGENI

SEQ ID NO: 597 - DNA, 1677 bp, Neisseria meningitidis
atgctgacctataccccgcccgatgcccgcccgcccgccaaaacccacgaaaagccgtggctgttgctgttgatggcgtttgcctggttgtggcccggcgtgttttcccacgatttgtggaatcctgacgaacctgccgtctataccgccgtcgaagcactggcaggcagccccacccctttggttgcccatctgttcggtcaaatcgatttcggcataccgcccgtgtatctttgggttgccgccgcgttcaaacatttgctgtcgccgtgggctgccgacccgtatgatgccgcacgctttgccggcgtgtttttcgccgttgtcggactgacttcctgcggctttgccggtttcaactttttgggcagacaccacgggcgcagcgtcgtcctgattctcatcggctgtatcgggctgattccgaccgtacactttctcaaccccgctgccgccgcctttgccgccgccggactggtgctgcacggttattctttggctcgccggcgcgtgattgccgcctcttttctgctcggtacgggttggacgctgatgtcgttggcagcagcttatccggcggcatttgccctgatgctgcccctgcccgtgctgatgtttttccgtccgtggcaaagcaggcgtttgatgttgacggcagtcgcctcgcttgcctttgccctgccgcttatgaccgtttacccgctgctcttggcaaaaacgcagcccgcgctgttcgcgcaatggctcgacgatcacgttttcggtacgttcggcggcgtgcggcacattcagacggcattcagtttgttttactatctgaaaaacctgctttggtttgcattgcctgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgagacgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccgcaaaaacatacgcggcaggcaggcggttaccaactgggcggcaggcgttaccctgacctgggctttgctgatgacgctgttcctgccgtggctggacgcggcgaaaagccacgcgcccgtcgtccggagtatggaggcatcgctttccccggaattaaaacgggagctttcagacggcatcgagtgtatcgacataggcggcggcgacctacacacgcggattgtttggacgcagtacggcacattgccgcaccgcgtcggcgatgtacaatgccgctaccgcatcgtccgcttgccccaaaacgcggatgcgccgcaaggctggcagacggtctggcagggtgcgcgcccgcgcaacaaagacagtaagttcgcactgatacggaaaaccggggaaaatatattaaaaacaacagattga

SEQ ID NO: 598 - protein, 558 aa, Neisseria meningitidis
MLTYTPPDARPPAKTHEKPWLLLLMAFAWLWPGVFSHDLWNPDEPAVYTAVEALAGSPTPLVAHLFGQIDFGIPPVYLWVAAAFKHLLSPWAADPYDAARFAGVFFAVVGLTSCGFAGFNFLGRHHGRSVVLILIGCIGLIPTVHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLDDHVFGTFGGVRHIQTAFSLFYYLKNLLWFALPALPLAVWTVCRTRLFSTDWGILGVVWMLAVLVLLAVNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASLSPELKRELSDGIECIDIGGGDLHTRIVWTQYGTLPHRVGDVQCRYRIVRLPQNADAPQGWQTVWQGARPRNKDSKFALIRKTGENILKTTD

SEQ ID NO: 599 - DNA, 8 bp, Neisseria gonorrhoeae
  misc_feature (1)..(8): N= Unknown
nnnnnnnn

SEQ ID NO: 600 - protein, 585 aa, Neisseria gonorrhoeae
MPSEAVSARPLCEYLLHLAIRPFLLTLMLTYTPPDARPPAKTHEKPWLLLLMAFAWLWPGVFSHDLWNPAEPAVYTAVEALAGSPTPLVAHLFGQTDFGIPPVYLWVAAAFKHLLSPWAAHPYDAARFAGVFFAVIGLTSCGFAGFNFLGRHHGRSVVLIHIGCIGLIPVAHFFNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 601 - DNA, 1677 bp, Neisseria gonorrhoeae
atgctgacctataccccgcccgatgcccgcccgcccgccaaaacccacgaaaaaccgtggctgctgctgttgatggcgtttgcctggctgtggcccggcgtgttttcccacgatttgtggaatcctgccgaacctgccgtctataccgccgtcgaagcactggcaggcagccccacccccttggttgcccatctgttcggtcaaaccgatttcggcataccgcccgtgtatctttgggttgccgccgcattcaaacatttgctgtcgccgtgggcagccgacccgtatgatgccgcacgctttgcaggcgtattttttgccgttatcggactgacttcttgcggctttgccggtttcaactttttgggcagacaccacgggcgcagcgttgttttaatccatatcggctgtatcgggctgattccggttgcccatttcctcaatcccgccgccgccgcctttgccgccgccggactggtgctgcacggctactcgctggcacgccggcgcgtgattgccgcctctttcctgctcggtacgggttggacgttgatgtcgctggcggcagcttatccggcggcgtttgcgctgatgctgcccctgcccgtgctgatgtttttccgtccgtggcaaagcaggcgtttgatgttgacggcagtcgcctcgcttgcctttgccctgccgcttatgaccgtttacccgctgctcttggcaaaaacgcagcccgcgctgtttgcgcaatggctcaactatcacgttttcggtacgttcggcggcgtgcggcacattcagagggcattcagtttgtttcactatctgaaaaatctgctttggttcgcaccgcccgggctgccgctggcggtttggacggtttgccgcacacgcctgttttcgaccgactgggggattttgggcattgtctggatgcttgccgttttggtgctgctcgcctttaatccgcagcgttttcaagacaacctcgtctggctgctgccgccgcttgccctgttcggcgcggcgcaactggacagcctgaggcgcggcgcggcggcttttgtcaactggttcggcattatggcgttcgggctgtttgccgtgttcctgtggacgggctttttcgccatgaattacggctggcccgccaagcttgccgaacgcgccgcctacttcagcccgtattacgttcccgacatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgcccgtcgtccggagtatggaggcatcgttttccccggaattaaaacgggagctttcagacggcatcgagtgtatcggcataggcggcggcgacctgcacacgcggattgtttggacgcagtacggcacattgccgcaccgcgtcggcgatgtccgttgccgctaccgtatcgtccgcctgccccaaaacgcggatgcgccgcaaggctggcagacggtctggcagggtgcgcgcccgcgcaacaaagacagtaagtttgcactgatacggaaaatcggggaaaatatattaaaaacaacagattga

SEQ ID NO: 602 - protein, 558 aa, Neisseria gonorrhoeae
MLTYTPPDARPPAKTHEKPWLLLLMAFAWLWPGVFSHDLWNPAEPAVYTAVEALAGSPTPLVAHLFGQTDFGIPPVYLWVAAAFKHLLSPWAADPYDAARFAGVFFAVIGLTSCGFAGFNFLGRHHGRSVVLIHIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQRAFSLFHYLKNLLWFAPPGLPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 603 - protein, 180 aa, Neisseria meningitidis
CAATCCGCCAAATGGTTATCGGGCCAAACTCTAGTCGGCACAGCAATTGGGATACGCGGGCAGATAAAGCTTGGCGGCAACCTGCATTACGATATATTTACCGGCCGCGCATTGAAAAAGCCCGAATTTTTCCAATCAAGGAAATGGGCAAGCGGTTTTCAGGTAGGCTATACGTTTTAA

SEQ ID NO: 604 - protein, 59 aa, Neisseria meningitidis
QSAKWLSGQTLVGTAIGIRGQIKLGGNLHYDIFTGRALKKPEFFQSRKWASGFQVGYTF

SEQ ID NO: 605 - DNA, 1029 bp, Neisseria meningitidis
atggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaa

SEQ ID NO: 606 - protein, 342 aa, Neisseria meningitidis
MDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 607 - DNA, 1029 bp, Neisseria gonorrhoeae
atggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 608 - protein, 342 aa, Neisseria gonorrhoeae
MDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 609 - DNA, 332 bp, Neisseria meningitidis
atgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgwcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaac

SEQ ID NO: 610 - protein, 110 aa, Neisseria meningitidis
  misc_feature (49)..(49): Xaa= any amino acid
MRTKWSAVRSCTWADTADIDTALNLLYRLQKLEFLYGDENGHSDGINLXDEQLPLLMEQLSGSGKALLVDRNGLYLANANFHHEAAEELGLLAAEVAQMEKKYRLLIKNN

SEQ ID NO: 611 - DNA, 645 bp, Neisseria meningitidis
atggaatcaacactttcactacaagcaaatttatatccccgcctgactcctgccggtgcattttatgccgtatccagcgatgcccccagtgccggtaaaactttgttgcacagcctgttgaaagcagatgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggattttataccgccgttacagcaaccgcgtgtaa

SEQ ID NO: 612 - protein, 214 aa, Neisseria meningitidis
MESTLSLQANLYPRLTPAGAFYAVSSDAPSAGKTLLHSLLKADADEMVSSEKLLTWADTADIDTALNLLYRLQKLEFLYGDENGHSDGINLSDEQLPLLMEQLSGSGKALLVDRNGLYLANANFHHEAAEELGLLAAEVAQMEKKYRLLIKNNLYINNNAWGVCDPSGQSELTFFPLYIGSTKFILVIGGIPDLGKEAFVTLVRILYRRYSNRV

SEQ ID NO: 613 - DNA, 684 bp, Neisseria meningitidis
  misc_feature (13)..(13): N= Unknown
  misc_feature (38)..(38): N= Unknown
  misc_feature (83)..(83): N= Unknown
  misc_feature (144)..(144): N= Unknown
  misc_feature (174)..(174): N= Unknown
  misc_feature (446)..(447): N= Unknown
  misc_feature (615)..(615): N= Unknown
  misc_feature (623)..(623): N= Unknown
  misc_feature (626)..(626): N= Unknown
  misc_feature (663)..(663): N= Unknown
atggaatcaacantttcactacaagcaaatttatatcnccgcctgactcctgccggtgcattttatgccgtatccagcgatgnccccagtgccggtaaaactttgttgcacagcctgttgaaagcggatgcggacgaaatggtnagcagtgagaagctgcttacctgggcgganaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgcnnattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggatnttataccnccngttacagcaaccgcgtgtaaaacttgggagagaggangggttatgcagcaattattga

SEQ ID NO: 614 - protein, 227 aa, Neisseria meningitidis
  misc_feature (5)..(5): Xaa= any amino acid
  misc_feature (13)..(13): Xaa= any amino acid
  misc_feature (28)..(28): Xaa= any amino acid
  misc_feature (58)..(58): Xaa= any amino acid
  misc_feature (149)..(149): Xaa= any amino acid
  misc_feature (205)..(205): Xaa= any amino acid
  misc_feature (208)..(209): Xaa= any amino acid
  misc_feature (221)..(221): Xaa= any amino acid
MESTXSLQANLYXRLTPAGAFYAVSSDXPSAGKTLLHSLLKADADEMVSSEKLLTWAXTADIDTALNLLYRLQKLEFLYGDENGHSDGINLSDEQLPLLMEQLSGSGKALLVDRNGLYLANANFHHEAAEELGLLAAEVAQMEKKYRLXIKNNLYINNNAWGVCDPSGQSELTFFPLYIGSTKFILVIGGIPDLGKEAFVTLVRXLYXXLQQPRVKLGREXGLCSNY

SEQ ID NO: 615 - DNA, 8 bp, Neisseria gonorrhoeae
  misc_feature (1)..(8): N= Unknown
nnnnnnnn

SEQ ID NO: 616 - protein, 298 aa, Neisseria gonorrhoeae
MRTKWSAVRSCSRADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKGGICYFGKDFIPPLQQPRVKLGTGGIMRQLLISILEDLNNTSTDIIASAVISTDGLPMATMLPSHLNSDRVGAISATLLALGSRSVQELACGELEQVMIKGKSGYILLSQAGKDAVLVLVAKETGRLGLILLDAKRAARHIAEAI

SEQ ID NO: 617 - DNA, 642 bp, Neisseria gonorrhoeae
atggaatcaacactttcactacaagcgaatttatatccctgcctgactcctgccggtgcattttatgccgtatccagcgatgcccccagtgccggtaaaactttgttgcgcagcctgttgaaagcggatgcggacgaagtggtcagcagtgagaagctgctcgcggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcattattggtcgatcggaacggtctgtatcttgccaacgccaatttccatcatgagtcggcggaagagttggggttgttggcggcagaagtcgcacagatggaaaagaaataccggctgctgattaggaacaacctgtatatcaacaataacgcttggggcgtttgcgatccttccggtcagagcgaattgacatttttcccattgtatatcggttcaaccaaatttattttggttatcgccggcattcccgatttgagcaaagaggcatttgttactttggtaaggattttataccgccgttacagcaaccgcgtgtaa

SEQ ID NO: 618 - protein, 213 aa, Neisseria gonorrhoeae
MESTLSLQANLYPCLTPAGAFYAVSSDAPSAGKTLLRSLLKADADEVVSSEKLLAADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKEAFVTLVRILYRRYSNRV

SEQ ID NO: 619 - DNA, 408 bp, Neisseria meningitidis
atgacctttttacaacgtttgcaaggtttggcagacaataaaatctgtgcgtttgcatggttcgtcgtccgccgctttgatgaagaacgcgtaccgcagrcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcaggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggacgggtcaawtyccagcgtccgtggatg

SEQ ID NO: 620 - protein, 136 aa, Neisseria meningitidis
  misc_feature (34)..(34): Xaa= any amino acid
  misc_feature (81)..(81): Xaa= any amino acid
  misc_feature (130)..(131): Xaa= any amino acid
MTFLQRLQGLADNKICAFAWFVVRRFDEERVPQXAASMTFTTLLALVPVLTVMVAVASIFPVFDRWSDSFVSFVNQTIVPXGADMVFDYINAFREQANRLTAIGSVMLVVTSLMLIRTIDNTFNRIWRVXXQRPWM

SEQ ID NO: 621 - DNA, 1221 bp, Neisseria meningitidis
atgacctttttacaacgtttgcaaggtttggcagacaataaaatctgtgcgtttgcatggttcgtcgtccgccgctttgatgaagaacgcgtaccgcaggcggcggcaagcatgacgtttacgacgctgctggcactcgtccccgtgctgaccgtgatggtggcggtcgcttcgattttccccgtgttcgaccgctggtcggattcgttcgtctccttcgtcaaccaaaccattgtgccgcagggcgcggacatggtgttcgactatatcaatgcgttccgcgagcaggcgaaccggctgacggcaatcggcagcgtgatgctggtcgttacctcgctgatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatggtcggctcggtacaggatgccgcgcttgcctcaggtgcgccgcagtggtcgggcgcgttgcgaacggcggcgacgctgaccttcatgacgcttttgctgtgggggctgtaccgcttcgtgccaaaccgcttcgttcccgcgcggcaggcgtttgtcggggctttggcaacagcgttttgtctggaaaccgcgcgctccctcttcacttggtatatgggcaatttcgacggctaccgctcgatttacggcgcgtttgccgccgtgccgttttttctgttgtggctgaacctgttgtggacgctggtcttgggcggcgcggtgctgacttcttcactctcctactggcagggagaagcgttccgcaggggcttcgactcgcgcggacggtttgacgacgtgttgaaaatcctgctgcttctggatgcggcgcaaaaagaaggcaaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgacaccgtgtttgcagactttgaacatgacgctggcagagtttgacgctcaggcgaaaaaacggcagtag

SEQ ID NO: 622 - protein, 406 aa, Neisseria meningitidis
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSLMLIRTIDNTFNRIWRVNSQRPWMMQFLVYWALLTFGPLSLGVGISFMVGSVQDAALASGAPQWSGALRTAATLTFMTLLLWGLYRFVPNRFVPARQAFVGALATAFCLETARSLFTWYMGNFDGYRSIYGAFAAVPFFLLWLNLLWTLVLGGAVLTSSLSYWQGEAFRRGFDSRGRFDDVLKILLLLDAAQKEGKALPVQEFRRHINMGYDELGELLEKLARHGYIYSGRQGWVLKTGADSIELNELFKLFVYRPLPVERDHVNQAVDAVMTPCLQTLNMTLAEFDAQAKKRQ

SEQ ID NO: 623 - DNA, 1227 bp, Neisseria meningitidis
  misc_feature (195)..(195): N= Unknown
  misc_feature (258)..(258): N= Unknown
  misc_feature (338)..(338): N= Unknown
  misc_feature (480)..(480): N= Unknown
  misc_feature (560)..(560): N= Unknown
  misc_feature (596)..(596): N= Unknown
  misc_feature (627)..(627): N= Unknown
  misc_feature (729)..(729): N= Unknown
  misc_feature (848)..(848): N= Unknown
  misc_feature (922)..(922): N= Unknown
atgacctttttacaacgtttgcaaggtttggcagacaataaaatctgtgcgtttgcatggttcgtcgtccgccgctttgatgaagaacgcgtaccgcaggcggcggcaagcatgacgtttacgacactgctggcactcgtccccgtgctgaccgtgatggtggcggtcgcttcgattttccccgtgttcgaccgntggtcggattcgttcgtctccttcgtcaaccaaaccattgtgccgcagggcgcggacatggtnttcgactatatcaatgcgttccgcgagcaggcgaaccggctgacggcaatcggcagcgtgatgctggtcgttacctcgcngatgctgattcggacgatagacaatacgttcaaccgcatctggcgggtcaattcccagcgtccgtggatgatgcagtttctcgtctattgggctttactgacgttcgggccgctgtctttgggcgtgggcatttcctttatngtcggctcggtacaggatgccgcgcttgcctcaggtgcgccgcagtggtcgggcgcgttgcgaacggcggcgacgctgancttcatgacgcttttgctgtgggggctgtaccgctncgtgccaaaccgcttcgttcccgcgcggcangcgtttgtcggggctttggcaacagcgttctgtctggaaaccgcgcgttccctctttacttggtatatgggcaatttcgacggctaccgctcgatttacggngcgtttgccgccgtgccgttttttctgttgtggctgaacctgttgtggacgctggtcttgggcggcgcggtgctgacttcttcactctcctactggcagggagaagcgttccgcagggncttcgactcgcgcggacggtttgacgacgtgttgaaaatcctgctgcttctggatgcggcgcaaaaagaaggcnaagccttgcctgttcaggagttcagacggcatatcaatatgggctacgacgagttgggcgagcttttggaaaagctggcgcggcacggctacatctattccggcagacagggttgggtgttgaaaacgggggcggattcgattgagttgaacgaactcttcaagctcttcgtttaccgtccgttgcctgtggaaagggatcatgtgaaccaagctgtcgatgcggtaatgatgccgtgtttgcagactttgaacatgacgctggcagagtttgacgctcaggcgaaaaaacagcagcaatcttga

SEQ ID NO: 624 - protein, 408 aa, Neisseria meningitidis
  misc_feature (113)..(113): Xaa= any amino acid
  misc_feature (160)..(160): Xaa= any amino acid
  misc_feature (187)..(187): Xaa= any amino acid
  misc_feature (199)..(199): Xaa= any amino acid
  misc_feature (209)..(209): Xaa= any amino acid
  misc_feature (283)..(283): Xaa= any amino acid
  misc_feature (308)..(308): Xaa= any amino acid
MTFLQRLQGLADNKICAFAWFVVRRFDEERVPQAAASMTFTTLLALVPVLTVMVAVASIFPVFDRWSDSFVSFVNQTIVPQGADMVFDYINAFREQANRLTAIGSVMLVVTSXMLIRTIDNTFNRIWRVNSQRPWMMQFLVYWALLTFGPLSLGVGISFXVGSVQDAALASGAPQWSGALRTAATLXFMTLLLWGLYRXVPNRFVPARXAFVGALATAFCLETARSLFTWYMGNFDGYRSIYGAFAAVPFFLLWLNLLWTLVLGGAVLTSSLSYWQGEAFRRXFDSRGRFDDVLKILLLLDAAQKEGXALPVQEFRRHINMGYDELGELLEKLARHGYIYSGRQGWVLKTGADSIELNELFKLFVYRPLPVERDHVNQAVDAVMMPCLQTLNMTLAEFDAQAKKQQQS

SEQ ID NO: 625 - DNA, 8 bp, Neisseria gonorrhoeae
  misc_feature (1)..(8): N= Unknown
nnnnnnnn

SEQ ID NO: 626 - protein, 408 aa, Neisseria gonorrhoeae
MTFLQCWQGSADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 627 - DNA, 1227 bp, Neisseria gonorrhoeae
atgacctttttacaacgttggcaaggtttggcggacaataaaatctgtgcatttgcatggttcgtcatccgccgtttcagtgaagagcgcgtaccgcaggcagcggcgagcatgacgtttacgacactgctggcactcgtccccgtactgaccgtaatggtcgcggtcgcttcgattttccccgtgttcgaccgctggtcggattcgttcgtctccttcgtcaaccaaaccattgtgccgcagggcgcggatatggtgttcgactatatcgacgcattccgcgatcaggcaaaccggctgaccgccatcggcagcgtgatgctggtcgtaacctcgctgatgctgattcggacgatagacaatgcgttcaaccgcatctggcgggttaacacgcaacgcccctggatgatgcagttcctcgtttattgggcgttgctgactttcgggcctttgtctttgggtgtgggcatttcctttatggtcgggtcggttcaagactccgtactctcctccggagcgcaacaatgggcggacgcgttgaagacggcggcaaggctggctttcatgacgcttttgctgtgggggctgtaccgcttcgtgcccaaccgcttcgtgcccgcccggcaggcgtttgtcggagctttgattacggcattctgcctggagacggcacgtttcctgttcacctggtatatgggcaatttcgacggctaccgctcgatttacggcgcatttgccgccgtgccgtttttcctgctgtggttaaacctgctgtggacgctggtcttgggcggggcggtgctgacttcgtcgctgtcttattggcagggcgaggccttccgcaggggattcgactcgcgcggacggtttgacgacgtgttgaaaatcctgctgcttctggatgcggcgcaaaaagaaggccgaaccctgtccgttcaggagttcagacggcatatcaatatgggttacgatgaattgggcgagcttttggaaaagctggcgcggtacggctatatctattccggcagacagggctgggttttgaaaacgggggcggattcgattgagttgagcgaactcttcaagctcttcgtgtaccgcccgttgcctgtggaaagggatcatgtgaaccaagctgtcgatgcggtaatgacgccgtgtttgcagactttgaacatgacgctggcggagtttgacgctcaggcgaaaaaacagcagcagtcttga

SEQ ID NO: 628 - protein, 408 aa, Neisseria gonorrhoeae
MTFLQRWQGLADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 629 - DNA, 228 bp, Neisseria meningitidis
agacacgcccgccgcatccgcatcgacaccgccatcaaccccgaactggaagccctcgccgaacacctccactaccaatggcagggcttcctctggctcagcaccgatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 630 - protein, 75 aa, Neisseria meningitidis
RHARRIRIDTAINPELEALAEHLHYQWQGFLWLSTDMRQEISALVILLQRTRRKWLDAHERQHLRQSLLETREHG

SEQ ID NO: 631 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 632 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHG

SEQ ID NO: 633 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcggggctgacgatgtgcatgctcatcggcgacaacggcagcgaatggttcgacagcggcctgatgcgcgcgatgaacgtcctcatcggcgcggccatcgccatcgccgccgccaaactgctgccgctgaaatccacactgatgtggcgtttcatgcttgccgacaacctgaccgactgcagcaaaatgattgccgaaatcagcaacggcaggcgcatgacccgcgaacgcctcgaagagaacatggcgaaaatgcgccaaatcaacgcacgcatggtcaaaagccgcagccacctcgccgccacatcgggcgaaagccgcatcagccccgccatgatggaagccatgcagcacgcccaccgtaaaattgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacagttga

SEQ ID NO: 634 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWFDSGLMRAMNVLIGAAIAIAAAKLLPLKSTLMWRFMLADNLTDCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHS

SEQ ID NO: 635 - DNA, 8 bp, Neisseria gonorrhoeae
  misc_feature (1)..(8): N= Unknown
nnnnnnnn

SEQ ID NO: 636 - protein, 409 aa, Neisseria gonorrhoeae
MSGVRFPSPAPIPSTDPPSGSLCFFTFPLQTASDMNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVIPLQRTRRKWLDAHERQHLRQSLLETREHG

SEQ ID NO: 637 - DNA, 1128 bp, Neisseria gonorrhoeae
atgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaacgcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 638 - protein, 375 aa, Neisseria gonorrhoeae
MNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 639 - DNA, 710 bp, Neisseria meningitidis
gccgaagacacgcgcgttaccgcacagcttttgagcgcgtacggcattcagggcaaactcgtcagtgtgcgcgaacacaacgaacggcagatggcggacaagattgtcggctatctttcagacggcatggttgtggcacaggtttccgatgcgggtacgccggccgtgtgcgacccgggcgcgaaactcgcccgccgcgtgcgtgaggccgggtttaaagtcgttcccgtcgtgggcgcaacgcggtgatggcggctttgagcgtggccggtgtggaaggatccgatttttatttcaacggttttgtaccgccgaaatcgggagaacgcaggaaactgtttgccaaatgggtgcgggcggcgtttcctatcgtcatgtttgaaacgccgcaccgcatcggtgcagcgcttgccgatatggcggaactgttccccgaacgccgattaatgctggcgcgcgaaattacgaaaacgtttgaaacgttcttaagcggcacggttggggaaattcagacggcattgtctgccgacggcgaccaatcgcgcggcgagatggtgttggtgctttatccggcgcaggatgaaaaacacgaaggcttgtccgagtccgcgcaaaacatcatgaaaatcctcacagccgagctgccgaccaaacaggcggcggagcttgctgccaaaatcacgggcgagggaaagaaagctttgtacgat

SEQ ID NO: 640 - protein, 237 aa, Neisseria meningitidis
  misc_feature (81)..(81): Xaa= any amino acid
AEDTRVTAQLLSAYGIQGKLVSVREHNERQMADKIVGYLSDGMVVAQVSDAGTPAVCDPGAKLARRVREAGFKVVPVVGAXAVMAALSVAGVEGSDFYFNGFVPPKSGERRKLFAKWVRAAFPIVMFETPHRIGAALADMAELFPERRLMLAREITKTFETFLSGTVGEIQTALSADGDQSRGEMVLVLYPAQDEKHEGLSESAQNIMKILTAELPTKQAAELAAKITGEGKKALYD

SEQ ID NO: 641 - DNA, 876 bp, Neisseria meningitidis; identical to SEQ ID NO: 287

SEQ ID NO: 642 - protein, 291 aa, Neisseria meningitidis; identical to SEQ ID NO: 288

SEQ ID NO: 643 - DNA, 8 bp, Neisseria gonorrhoeae
  misc_feature (1)..(8): N= Unknown
nnnnnnnn

SEQ ID NO: 644 - protein, 300 aa, Neisseria gonorrhoeae; identical to SEQ ID NO: 292

SEQ ID NO: 645 - DNA, 876 bp, Neisseria gonorrhoeae; identical to SEQ ID NO: 293

SEQ ID NO: 646 - protein, 291 aa, Neisseria gonorrhoeae; identical to SEQ ID NO: 294

SEQ ID NO: 647 - DNA, 2938 bp, Neisseria meningitidis
  misc_feature (2439)..(2439): N= Unknown
atgaaaacaaccgacaaacggacaaccgaaacacaccgcaaagccccgaaaaccggtcgcatccgcttctcgctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgtatcaatatattgtgagcgtggcacataacggcggctataacaacgttgattttggtgcggaaggaakaatatcccgatcaacawcgwwttacttataaaattgtgaaacggaataattataaagcagggactaaaggccatccttatggcggcgattatcatatgccgcgtttgcataaatwtgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctggataaagtgactgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccktagcctcgtggsaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggarcggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatmcgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgcaggcgcgtggttagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagncgcgggcgcgggttttagcagcggcagcctttcagacggcatcggagsmaaawtccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 648 - protein, 979 aa, Neisseria meningitidis
  misc_feature (24)..(24): Xaa= any amino acid
  misc_feature (129)..(129): Xaa= any amino acid
  misc_feature (132)..(132): Xaa= any amino acid
  misc_feature (135)..(135): Xaa= any amino acid
  misc_feature (137)..(137): Xaa= any amino acid
  misc_feature (168)..(168): Xaa= any amino acid
  misc_feature (479)..(479): Xaa= any amino acid
  misc_feature (483)..(483): Xaa= any amino acid
  misc_feature (577)..(577): Xaa= any amino acid
  misc_feature (624)..(624): Xaa= any amino acid
  misc_feature (830)..(830): Xaa= any amino acid
  misc_feature (832)..(832): Xaa= any amino acid
MKTTDKRTTETHRKAPKTGRIRFXAAYLAICLSFGILPQAWAGHTYFGINYQYYRDFAENKGKFAVGAKDIEVYNKKGELVGKSMTKAPMIDFSVVSRNGVAALVGVQYIVSVAHNGGYNNVDFGAEGXNIXDQXRXTYKIVKRNNYKAGTKGHPYGGDYHMPRLHKXVTDAEPVEMTSYMDGRKYIDQNNYPDRVRIGAGRQYWRSDEDEPNNRESSYHIASGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLDKVTASLTKTDISGNVDLADHAHLNLTGLATLNGNLSANGDTRYTVSHNATQNGNXSLVXNAQATFNQATLNGNTSASGNASFNLSDHAVQNGSLTLSGNAKANVSHSALNGNVSLADKAVFHFESSRFTGQISGGKDTALHLKDSEWTLPSGXELGNLNLDNATITLNSAYRHDAAGAQTGSATDAPRRRSRRSRRSLLXVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWLDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGXKXRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 649 - DNA, 4374 bp, Neisseria meningitidis
atgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 650 - protein, 1457 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 651 - DNA, 4350 bp, Neisseria meningitidis
  misc_feature (219)..(219): N= Unknown
  misc_feature (387)..(387): N= Unknown
  misc_feature (474)..(474): N= Unknown
  misc_feature (706)..(706): N= Unknown
  misc_feature (941)..(941): N= Unknown
  misc_feature (1026)..(1026): N= Unknown
  misc_feature (1492)..(1492): N= Unknown
  misc_feature (1643)..(1643): N= Unknown
  misc_feature (1645)..(1645): N= Unknown
  misc_feature (1841)..(1841): N= Unknown
  misc_feature (2008)..(2008): N= Unknown
  misc_feature (2094)..(2094): N= Unknown
  misc_feature (2175)..(2175): N= Unknown
  misc_feature (2197)..(2197): N= Unknown
  misc_feature (2201)..(2201): N= Unknown
  misc_feature (2241)..(2241): N= Unknown
  misc_feature (2245)..(2245): N= Unknown
  misc_feature (2247)..(2247): N= Unknown
  misc_feature (2255)..(2255): N= Unknown
  misc_feature (2259)..(2259): N= Unknown
  misc_feature (2262)..(2262): N= Unknown
  misc_feature (2265)..(2266): N= Unknown
  misc_feature (2269)..(2269): N= Unknown
  misc_feature (2272)..(2272): N= Unknown
  misc_feature (2276)..(2276): N= Unknown
  misc_feature (2278)..(2279): N= Unknown
  misc_feature (2282)..(2282): N= Unknown
  misc_feature (2286)..(2286): N= Unknown
  misc_feature (2290)..(2290): N= Unknown
  misc_feature (2292)..(2292): N= Unknown
  misc_feature (2297)..(2297): N= Unknown
  misc_feature (2301)..(2301): N= Unknown
  misc_feature (2302)..(2302): N= Unknown
  misc_feature (2307)..(2307): N= Unknown
  misc_feature (2310)..(2310): N= Unknown
  misc_feature (2434)..(2434): N= Unknown
  misc_feature (2441)..(2441): N= Unknown
  misc_feature (2625)..(2625): N= Unknown
  misc_feature (2760)..(2760): N= Unknown
  misc_feature (2869)..(2869): N= Unknown
  misc_feature (2949)..(2949): N= Unknown
  misc_feature (3290)..(3290): N= Unknown
  misc_feature (3366)..(3366): N= Unknown
  misc_feature (3401)..(3401): N= Unknown
  misc_feature (3427)..(3427): N= Unknown
  misc_feature (3498)..(3498): N= Unknown
  misc_feature (3606)..(3606): N= Unknown
  misc_feature (3619)..(3619): N= Unknown
  misc_feature (3628)..(3628): N= Unknown
  misc_feature (3761)..(3761): N= Unknown
  misc_feature (3878)..(3878): N= Unknown
  misc_feature (3882)..(3882): N= Unknown
  misc_feature (4068)..(4068): N= Unknown
  misc_feature (4074)..(4074): N= Unknown
  misc_feature (4119)..(4119): N= Unknown
  misc_feature (4128)..(4128): N= Unknown
  misc_feature (4137)..(4137): N= Unknown
  misc_feature (4194)..(4194): N= Unknown
  misc_feature (4273)..(4273): N= Unknown
  misc_feature (4296)..(4296): N= Unknown
atgaaaacaaccgacaaacggacaaccgaaacacaccgcaaagccccgaaaaccggccgcatccgcttctcgcctgcttacttagccatatgcctgtcgttcggcattcttccccaagcttgggcgggacacacttatttcggcatcaactaccaatactatcgcgactttgccgaaaataaaggcaagtttgcagtcggggcgaaagatattgaggtntacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagnaatcccgatcagcaccgtttttcttaccaaattgtgaaaagaaataattataagcctgacaattcacacccttacaacggcgattancatatgccgcgtttgcataaatttgtcacagatgcagaacctgtcgaaatgacgagtgacatgagggggaatacctattccgataaagaaaaatatcccgagcgtgtccgcatcggctcaggacaccactattggcgttatgatgatgacaaacacggcgatttatcctactccggcgcatggttaattggcggcaatacacatatgcagggttggggaaataatggcgtanttagtttgagcggcgatgtgcgccatgccaacgactatggccctatgccgattgcaggtgcggcaggcgacagcggttcgccaatgtttatttatgacaaaacaaacaataaatggctgctcaacggagttttacaaaccggctacccttattccggcagggaaaacggtttccagctgatacgcaaagattggttctacgatgacatttacagaggcgatacacataccgtctnttttgaaccgcgcagtaacggacatttttcctttacatccaacaacaacggtacgggtacggtaacagaaaccaacgaaaaggtntccaatccaaagcttaaagtacagacagtccgactgtttgacgaatctttgaatgaaactgataaagaaccagtttacgcggcagggggtgttaatcagtaccgtccaaggttaaacaacggtgaaaacctttcttttatcgattacggcaacggcaaactcatcttatcaaacaacatcaaccaaggcgcgggcggtttgtattttgaaggtgattttacggtctcgcctgaaaacaacgaaacgtggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttgntcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgncnatcataatgccacaacaacatccaccgttaccattacagggaatgaaagtattacacaaccgagtggtaagaatatcaatagacttaattacagcaaagaaattgcctacaacggttggtttggcgagaaagatacgaccaaaacgaacgggcggctcaaccttgtttaccagcccgccgcagaagaccgcacccngctgctttccggcggaacaaatttaaacggcaacatcacgcaaacaaacggcaaactgtttttcagcggcagaccgacaccgcacgcctacaatcatttaggaagcgggtggtcaaaaatggaaggtatcccacaaggagaaatcgtgtgggacaacgactggatcnaccgcacgtttaaagcggaaaatttccatattcagggcgggcaggcggtgatttcccgcaatgttgccaaagtggaaggcgattgncatttgagcaatcacgcccaagcagtttttggtgtcgcaccgcatcaaagccatacaatctgtacacgttcggactggacnggtctgacaaattgtgtcgaanaaancattaccgacgataaagtgattgcttcattgactaagacngacntnagcggcantgtnagnctnnccnatnacgntnnttnaaanctcncngggcntgcnncactnaanggcaatcttagtgcaaatggcgatacacgttatacagtcagccacaacgccacccaaaacggcaaccttagcctcgtgggcaatgcccaagcaacatttaatcaagccacattaaacggcaacncatcggnttcgggcaatgcttcatttaatctaagcaacaacgccgcacaaaacggcagtctgacgctttccgacaacgctaaggcaaacgtaagccattccgcactcaacggcaatgtctccctagccgataaggcagtattccattttgaaaacagccgctttaccggacaactcagcggcagcaagganacagcattacacttaaaagacagcgaatggacgctgccgtcaggcacggaattaggcaatttaaaccttgacaacgccaccattacactcaattccgcctatcgccacgatgctgcaggcgcgcaaaccggcagngtgtcagacacgccgcgccgccgttcgcgccgttccctattatccgttacaccgccaacttcggtagaatcccgtttcaacacgctgacggtaaacggcaaattgaacngtcaaggaacattccgctttatgtcggaactcttcggctaccgaagcgacaaattgaagctggcggaaagttccgaaggnacttacaccttggcggtcaacaataccggcaacgaacccgtaagcctcgatcaattgacggtagtggaagggaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgccgaaaagacagaaagcgttgccgaaccggcccggcnggcaggcggggaaaatgtcggcattatgcaggcggaggaagagaaaaaacgggtgcaggcggataaagacagcgcnttggcgaaacagcgcgaagcggaaacccggccggntaccaccgccttcccccgcgcccgcngcgcccgccgggatttgccgcaaccgcagccccaaccgcaacctcaaccccaaccgcagcgcgacctgatnagccgttatgccaatagcggtttgagtgaattttccgccacgctcaacagcgttttcgccgtacaggacgaattggaccgcgtgtttgccgaagaccgccgcaacgcngtttggacaagcngcatccggnacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacancttcgacgacggcatcggcaactcggcacggcttgcccacggcgccgttttcgggcaatacggcatcggcaggttcgacatcggcatcagcacgggcgcgggttttagcagcggcantctntcagacggcatcggaggcaaaatccgccgccgcgtgctgcattacggcattcaggcacgataccgcgccggtttcggcggattcggcatcgaaccgtacatcggcgcaacgcgctatttcgtccaaaaagcggattaccgctacgaaaacgtcaatatcgccacccccggtcttgcgttcaaccgntaccgngcgggcattaaggcagattattcattcaaaccggcgcaacacatntccatcacnccttatttnagcctgtcctataccgatgccgcttcgggcaaagtccgaacacgcgtcaataccgcngtattggctcaggatttcggcaaaacccgcagtgcggaatggggcgtaaacgccgaaatcaaaggtttcacgctgtccntccacgctgccgccgccaaaggnccgcaactggaagcgcaacacagcgcgggcatcaaattaggctaccgctggtaa

SEQ ID NO: 652 - protein, 1449 aa, Neisseria meningitidis
  misc_feature (129)..(129): Xaa= any amino acid
  misc_feature (158)..(158): Xaa= any amino acid
  misc_feature (236)..(236): Xaa= any amino acid
  misc_feature (314)..(314): Xaa= any amino acid
  misc_feature (498)..(498): Xaa= any amino acid
  misc_feature (548)..(549): Xaa= any amino acid
  misc_feature (614)..(614): Xaa= any amino acid
  misc_feature (670)..(670): Xaa= any amino acid
  misc_feature (698)..(698): Xaa= any amino acid
  misc_feature (733)..(734): Xaa= any amino acid
  misc_feature (749)..(749): Xaa= any amino acid
  misc_feature (752)..(752): Xaa= any amino acid
  misc_feature (754)..(754): Xaa= any amino acid
  misc_feature (756)..(762): Xaa= any amino acid
  misc_feature (764)..(764): Xaa= any amino acid
  misc_feature (766)..(766): Xaa= any amino acid
  misc_feature (768)..(768): Xaa= any amino acid
  misc_feature (770)..(770): Xaa= any amino acid
  misc_feature (812)..(812): Xaa= any amino acid
  misc_feature (814)..(814): Xaa= any amino acid
  misc_feature (875)..(875): Xaa= any amino acid
  misc_feature (920)..(920): Xaa= any amino acid
  misc_feature (957)..(957): Xaa= any amino acid
  misc_feature (1097)..(1097): Xaa= any amino acid
  misc_feature (1134)..(1134): Xaa= any amino acid
  misc_feature (1143)..(1143): Xaa= any amino acid
  misc_feature (1166)..(1166): Xaa= any amino acid
  misc_feature (1207)..(1207): Xaa= any amino acid
  misc_feature (1210)..(1210): Xaa= any amino acid
  misc_feature (1254)..(1254): Xaa= any amino acid
  misc_feature (1293)..(1293): Xaa= any amino acid
  misc_feature (1373)..(1373): Xaa= any amino acid
  misc_feature (1379)..(1379): Xaa= any amino acid
  misc_feature (1425)..(1425): Xaa= any amino acid
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGXNPDQHRFSYQIVKRNNYKPDNSHPYNGDXHMPRLHKFVTDAEPVEMTSDMRGNTYSDKEKYPERVRIGSGHHYWRYDDDKHGDLSYSGAWLIGGNTHMQGWGNNGVXSLSGDVRHANDYGPMPIAGAAGDSGSPMFIYDKTNNKWLLNGVLQTGYPYSGRENGFQLIRKDWFYDDIYRGDTHTVXFEPRSNGHFSFTSNNNGTGTVTETNEKVSNPKLKVQTVRLFDESLNETDKEPVYAAGGVNQYRPRLNNGENLSFIDYGNGKLILSNNINQGAGGLYFEGDFTVSPENNETWQGAGVHISEDSTVTWKVNGVANDRLSKIGKGTLHVQAKGENQGSISVGDGTVILDQQADDKGKKQAFSEIGLXSGRGTVQLNADNQFNPDKLYFGFRGGRLDLNGHSLSFHRIQNTDEGAMIXXHNATTTSTVTITGNESITQPSGKNINRLNYSKEIAYNGWFGEKDTTKTNGRLNLVYQPAAEDRTXLLSGGTNLNGNITQTNGKLFFSGRPTPHAYNHLGSGWSKMEGIPQGEIVWDNDWIXRTFKAENFHIQGGQAVISRNVAKVEGDXHLSNHAQAVFGVAPHQSHTICTRSDWTGLTNCVEXXITDDKVIASLTKTDXSGXVXLXXXXXXXLXGXAXLXGNLSANGDTRYTVSHNATQNGNLSLVGNAQATFNQATLNGNXSXSGNASFNLSNNAAQNGSLTLSDNAKANVSHSALNGNVSLADKAVFHFENSRFTGQLSGSKXTALHLKDSEWTLPSGTELGNLNLDNATITLNSAYRHDAAGAQTGXVSDTPRRRSRRSLLSVTPPTSVESRFNTLTVNGKLNXQGTFRFMSELFGYRSDKLKLAESSEGTYTLAVNNTGNEPVSLDQLTVVEGKDNKPLSENLNFTLQNEHVDAGAWRYQLIRKDGEFRLHNPVKEQELSDKLGKAEAKKQAEKDNAQSLDALIAAGRDAAEKTESVAEPARXAGGENVGIMQAEEEKKRVQADKDSALAKQREAETRPXTTAFPRARXARRDLPQPQPQPQPQPQPQRDLXSRYANSGLSEFSATLNSVFAVQDELDRVFAEDRRNAVWTSXIRXTKHYRSQDFRAYRQQTDLRQIGMQKNLGSGRVGILFSHNRTENXFDDGIGNSARLAHGAVFGQYGIGRFDIGISTGAGFSSGXLSDGIGGKIRRRVLHYGIQARYRAGFGGFGIEPYIGATRYFVQKADYRYENVNIATPGLAFNRYRAGIKADYSFKPAQHXSITPYXSLSYTDAASGKVRTRVNTAVLAQDFGKTRSAEWGVNAEIKGFTLSXHAAAAKGPQLEAQHSAGIKLGYRW

SEQ ID NO: 653 - DNA, 4407 bp, Neisseria gonorrhoeae
atgaaaacaaccgacaaacggacaaccgaaacacaccgcaaagcccctaaaaccggccgcatccgcttctcgcccgcttacttagccatatgcctgtcgttcggcattctgccccaagcccgggcgggacacacttatttcggcatcaactaccaatactatcgcgactttgccgaaaataaaggcaagtttgcagtcggggcgaaagatattgaggtttacaacaaaaaaggggagttggtcggcaaatcgatgacgaaagccccgatgattgatttttctgtggtatcgcgtaacggcgtggcggcattggcgggcgatcaatatattgtgagcgtggcacataacggcggctataacaatgttgattttggtgcggagggaagcaatcccgatcagcaccgcttttcttaccaaattgtgaaaagaaataattataaagcagggactaacggccatccttatggcggcgattatcatatgccgcgtttgcacaaatttgtcacagatgcagaacctgttgagatgaccagttatatggatgggtggaaatacgctgatttaaataaataccctgatcgtgttcgaatcggagcaggcagacaatattggcggtctgatgaagacgaacccaataaccgcgaaagttcatatcatattgcaagcgcatattcttggctcgtcggtggcaatacctttgcacaaaatggatcaggtggtggcacagtcaacttaggtagcgaaaaaattaaacatagcccatatggttttttaccaacaggaggctcatttggcgacagtggctcaccaatgtttatctatgatgcccaaaagcaaaagtggttaattaatggggtattgcaaacaggcaacccctatataggaaaaagcaatggcttccagctagttcgtaaagattggttctatgatgaaatctttgctggagatacccattcagtattctacgaaccacatcaaaatgggaaatacttttttaacgacaataataatggcgcaggaaaaatcgatgccaaacataaacactattctctaccttatagattaaaaacacgaaccgttcaattgtttaatgtttctttatccgagacagcaagagaacctgtttatcatgctgcaggtggggtcaacagttatcgacccagactgaataatggagaaaatatttcctttattgacaaaggaaaaggtgaattgatacttaccagcaacatcaaccaaggcgcgggcggtttgtattttgagggtaattttacggtctcgcctaaaaacaacgaaacgtggcaaggcgcgggcgttcatatcagtgatggcagtaccgttacttggaaagtaaacggcgtggcaaacgaccgcctgtccaaaatcggcaaaggcacgctgctggttcaagccaaaggggaaaaccaaggctcggtcagcgtgggcgacggtaaagtcatcttagatcagcaggcggacgatcaaggcaaaaaacaagcctttagtgaaatcggcttggtcagcggcagggggacggtgcaactgaatgccgataatcagttcaaccccgacaaactctatttcggctttcgcggcggacgtttggatttgaacgggcattcgctttcgttccaccgcattcaaaataccgatgaaggggcgatgattgtcaaccacaatcaagacaaagaatccaccgttaccattacaggcaataaagatattactacaaccggcaataacaacaacttggatagcaaaaaagaaattgcctacaacggttggtttggcgagaaagatgcaaccaaaacgaacgggcggctcaatctgaattaccaaccggaagaagcggatcgcactttactgctttccggcggaacaaatttaaacggcaatatcacgcaaacaaacggcaaactgtttttcagcggcagaccgacaccgcacgcctacaatcatttaggaagcgggtggtcaaaaatggaaggtatcccacaaggagaaatcgtgtgggacaacgattggatcgaccgcacatttaaagcggaaaacttccatattcagggcggacaagcggtggtttcccgcaatgttgccaaagtggaaggcgattggcatttaagcaatcacgcccaagcagttttcggtgtcgcaccgcatcaaagccacacaatctgtacacgttcggactggacgggtctgacaagttgtaccgaaaaaaccattaccgacgataaagtgattgcttcattgagcaagaccgacatcagaggcaatgtcagccttgccgatcacgctcatttaaatctcacaggacttgccacactcaacggcaatcttagtgcaggcggagacacgcactatacggttacgcgcaacgccacccaaaacggcaacctcagcctcgtgggcaatgcccaagcaacatttaatcaagccacattaaacggcaacacatcggcttcggacaatgcttcatttaatctaagcaacaacgccgtacaaaacggcagtctgacgctttccgacaacgctaaggcaaacgtaagccattccgcactcaacggcaatgtctccctagccgataaggcagtattccattttgaaaacagccgctttaccggaaaaatcagcggcggcaaggatacggcattacacttaaaagacagcgaatggacgctgccgtcgggcacggaattaggcaatttaaaccttgacaacgccaccattacactcaattccgcctatcgacacgatgcggcaggcgcgcaaaccggcagtgcggcagatgcgccgcgccgccgttcgcgccgttccctattatccgttacgccgccaacttcggcagaatcccgtttcaacacgctgacggtaaacggcaaattgaacggtcagggaacattccgctttatgtcggaactcttcggctaccgcagcggcaaattgaagctggcggaaagttccgaaggcacttacaccttggctgtcaacaataccggcaacgaacccgtaagtctcgagcaattgacggtagtggaaggaaaagacaacacaccgctgtccgaaaatcttaatttcaccctgcaaaacgaacacgtcgatgccggcgcatggcgttatcagcttatccgcaaagacggcgagttccgcctgcataatccggtcaaagaacaagagctttccgacaaactcggcaaggcgggagaaacagaggccgccttgacggcaaaacaggcacaacttgccgccaaacaacaggcggaaaaagacaacgcgcaaagccttgacgcgctgattgcggccgggcgcaatgccaccgaaaaggcagaaagtgttgccgaaccggcccggcaggcaggcggggaaaatgccggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaaccgcagccccaaccgcaaccccaaccgcagcgcgacctgatcagccgttatgccaatagcggtttgagtgaattttccgccacgctcaacagcgttttcgccgtacaggacgaattggaccgcgtgtttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccggaaacaccttcgacgacggcatcggcaactcggcacggcttgcccacggtgccgttttcgggcaatacggcatcggcaggttcgacatcggcatcagcgcgggcgcgggttttagtagcggcagcctttcagacggcatcagaggcaaaatccgccgccgcgtgctgcattacggcattcaggcaagataccgcgcaggtttcggcggattcggcatcgaaccgcacatcggcgcaacgcgctatttcgtccaaaaagcggattaccgatacgaaaacgtcaatatcgccaccccgggccttgcattcaaccgctaccgcgcgggcattaaggcagattattcattcaaaccggcgcaacacatttccatcacgccttatttgagcctgtcctataccgatgccgcttccggcaaagtccgaacgcgcgtcaataccgccgtattggcgcaggatttcggcaaaacccgcagtgcggaatggggcgtaaacgccgaaatcaaaggtttcacgctgtccctccacgctgccgccgccaaggggccgcaattggaagcgcagcacagcgcgggcatcaaattaggctaccgctggtaa

SEQ ID NO: 654 - protein, 1468 aa, Neisseria gonorrhoeae
MKTTDKRTTETHRKAPKTGRIRFSPAYLAICLSFGILPQARAGHTYFGINYQYYRDFAENKGKFAVGAKDIEVYNKKGELVGKSMTKAPMIDFSVVSRNGVAALAGDQYIVSVAHNGGYNNVDFGAEGSNPDQHRFSYQIVKRNNYKAGTNGHPYGGDYHMPRLHKFVTDAEPVEMTSYMDGWKYADLNKYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPHQNGKYFFNDNNNGAGKIDAKHKHYSLPYRLKTRTVQLFNVSLSETAREPVYHAAGGVNSYRPRLNNGENISFIDKGKGELILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGGLNLNYPPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDVRGNVSLADHAHLNLTGLATFNGNLVQAETRTIRLRANATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTGNTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 655 - DNA, 422 bp, Neisseria meningitidis
aaggtgtggcaatttgtcgaagaccgctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataa

SEQ ID NO: 656 - protein, 140 aa, Neisseria meningitidis
  misc_feature (8)..(8): Xaa= any amino acid
KVWQFVEXPLRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 657 - DNA, 396 bp, Neisseria meningitidis
ctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataa

SEQ ID NO: 658 - protein, 131 aa, Neisseria meningitidis
LRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 659 - DNA, 606 bp, Neisseria meningitidis
atgacccgtcaatctctgcaacaggctgccgaaagccgccgttccatttattcgttaaataaaaatctgcccgtcggcaaagatgaaatcgtccaaatcgtcgaacacgccgttttgcacacaccttcttcgttcaattcccaatctgcccgtgtggtcgtgctgtttggcgaagagcatgataaggtgtggcaatttgtcgaagacgcgctgcgtgccgtcgtgcctgccgacagttttgaaccgaccgcgcaaaaattgaacctgtttaaggcgggtgcggcaactattttgttttatgaagatcaaaatgtcgtcaaaggtttgcaggagcagttccctgcttatgccgccaactttcccgtttgggcggaccaggcgaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaaccagttgcagaacgtttgaaagtgttcggcgcataa

SEQ ID NO: 660 - protein, 201 aa, Neisseria meningitidis
MTRQSLQQAAESRRSIYSLNKNLPVGKDEIVQIVEHAVLHTPSSFNSQSARVVVLFGEEHDKVWQFVEDALRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 661 - DNA, 525 bp, Neisseria gonorrhoeae
atggccgttgcgtcaaatgtcagcttggatatgtccaatcctacggtgttacgcatgggattacccttatatattgcgtccctaagaaggggcgcaatatataaggtgtggcaatttgtcgaagacgcgctgcgtgccgtcgtgcctgccgacagttttgaaccgaccgcgcaaaaattgaagctgtttaaggcgggcgcggcaaccattttgttttatgaagatcaaaatgtcgtcaaaggtttgcaggagcagttccctgcttatgccgccaactttcccgtttgggcggaccaggcgaacgctatggtacagtatgccgtctggacgacacttgccgcggtcggtgcaggtgcaaatctgcaacattacaaccccttgcccgatgtggcgattgctaaagcgtggaatattcccgaaaactggctgttgcgcgcgcaaatggttatcggtggtattgaaggggcggcaggtgaaaaagtctttgaacccgttgcggaacgtttgaaagtgttcggcgcataa

SEQ ID NO: 662 - protein, 174 aa, Neisseria gonorrhoeae
MAVASNVSLDMSNPTVLRMGLPLYIASLRRGAIYKVWQFVEDALRAVVPADSFEPTAQKLKLFKAGAATILFYEDQNVVKGLQEQFPAYAANFPVWADQANAMVQYAVWTTLAAVGAGANLQHYNPLPDVAIAKAWNIPENWLLRAQMVIGGIEGAAGEKVFEPVAERLKVFGA

SEQ ID NO: 663 - DNA, 633 bp, Neisseria meningitidis
ggctacaactacctgttcgcgcgcggcagccgcatcgccaactaccaaatcaacggcatccccgttgccgacgcgctggccgatacgggtcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaagcrcrctgcgcggccgcctggtttccaccttcggacgcggcgactcgtggcggcggcgcgaacgcagccgskatgccgaactctacggcattttggaatacgacatcgcaccgcaaacccgcgtccacgcargcatggactaccagcaggcgaaagaaaccgccgacgcgccgctcagctacgccgtgtacgacagccaaggttatgccaccgccttcggcccgaaagacaaccccgccacaaattgggcgaacagccaccaccgtgcgctcaacctgttcgccggcatcgaacaccgcttcaaccaagactggaaactcaaagccgaatacgactac

SEQ ID NO: 664 - protein, 211 aa, Neisseria meningitidis
  misc_feature (99)..(100): Xaa= any amino acid
  misc_feature (123)..(123): Xaa= any amino acid
  misc_feature (143)..(143): Xaa= any amino acid
GYNYLFARGSRIANYQINGIPVADALADTGNANTAAYERVEVVRGVAGLLDGTGEPSATVNLVRKRLTRKPLFEVRAEAGNRKHFGLDADVSGSLNTEXXLRGRLVSTFGRGDSWRRRERSRXAELYGILEYDIAPQTRVHAXMDYQQAKETADAPLSYAVYDSQGYATAFGPKDNPATNWANSHHRALNLFAGIEHRFNQDWKLKAEYDY

SEQ ID NO: 665 - DNA, 2178 bp, Neisseria meningitidis
atgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataa

SEQ ID NO: 666 - protein, 725 aa, Neisseria meningitidis
MTRFKYSLLFAALLPVYAQADVSVSDDPKPQESTELPTITVTADRTASSNDGYTVSGTHTPLGLPMTLREIPQSVSVITSQQMRDQNIKTLDRALLQATGTSRQIYGSDRAGYNYLFARGSRIANYQINGIPVADALADTGNANTAAYERVEVVRGVAGLLDGTGEPSATVNLVRKRLTRKPLFEVRAEAGNRKHFGLDADVSGSLNTEGTLRGRLVSTFGRGDSWRRRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYTRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 667 - DNA, 2178 bp, Neisseria meningitidis
atgacacgcttcaaatattccctgctgtttgccgccctgttgcccgtgtacgcgcaggccgatgtttctgtttcagacgacccaaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaagcgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcccgacccgcaagccattgtttgaagtccgcgccgaagcgggcaaccgcaaacatttcgggctgggcgcggacgtatcgggcagcctgaatgccgaaggcacgctgcgcggccgcctggtttccaccttcggacgcggcgactcgtggcggcagcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattaatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgatactcggcggcagatacagccgttaccgcaccggcagctacgacagccgcacacaaggcatgacctatgtgtccgccaaccgtttcaccccctacacaggcatcgtgttcgacctgaccggcaacctgtcgctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataa

SEQ ID NO: 668 - protein, 725 aa, Neisseria meningitidis
MTRFKYSLLFAALLPVYAQADVSVSDDPKPQESTELPTITVTADRTASSNDGYTVSGTHTPLGLPMTLREIPQSVSVITSQQMRDQNIKALDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNAEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 669 - DNA, 8 bp, Neisseria gonorrhoeae
  misc_feature (1)..(8): N= Unknown
nnnnnnnn

SEQ ID NO: 670 - protein, 623 aa, Neisseria gonorrhoeae
SAVDACRIPGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 671 - DNA, 2178 bp, Neisseria gonorrhoeae
atgacacgcttcaaatactccctgctttttgccgccctgctacccgtgtacgcgcaggccgatgtttctgtttcagacgaccccaaaccgcaggaaagcaccgaattgccgaccatcaccgttaccgccgaccgcaccgcgagttccaacgacggctacaccgtttccggcacgcacaccccgttcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgccggacggcacgggcgagccttctgccaccgtcaatctggtacgcaaacacccgacccgcaagccattgtttgaagtccgcgccgaagccggcaaccgcaaacatttcgggctgggcgcggacgtatcgggcagcctgaacgccgaaggcacgctgcgcggccgcctggtttccaccttcggacgcggcgactcgtggcggcagctcgaacgcagccgcgatgccgaactctacggcattttggaatacgacatcgcaccgcaaacccgcgtccacgcaggcatggactaccagcaggcgaaagaaaccgcagacgcgccgctcagctacgccgtgtacgacagccaaggttatgccaccgccttcggcccaaaagacaaccccgccacaaattggtcgaacagccgcaaccgtgcgctcaacctgttcgccggcatagaacaccgcttcaaccaagactggaaactcaaagccgaatacgactacacccgtagccgcttccgccagccctacggtgtggcaggcgtactttccatcgaccacagcactgccgccaccgacctgattcccggttattggcacgccgatccgcgcacccacagcgccagcatgtcattgaccggcaaataccgcctgttcggccgcgagcacgatttaatcgcgggtatcaacggctacaaatacgccagcaacaaatacggcgaacgcagcatcattcccaacgccattcccaacgcctacgaattttcccgcacgggcgcctatccgcagccatcatcgtttgcccaaaccatcccgcaatacgacaccaggcggcaaatcggcggctatctcgccacccgtttccgcgccgccgacaacctttcgctgatactcggcggcagatacagccgctaccgcgcaggcagctacaacagccgcacacaaggcatgacctatgtgtccgccaaccgtttcaccccctacacaggcatcgtgttcgatctgaccggcaacctgtcgctttacggctcgtacagcagcctgttcgtcccgcaattgcaaaaagacgaacacggcagctacctgaaacccgtaaccggcaacaatctggaagccgacatcaaaggcgaatggcttgaagggcgtctgaacgcatccgccgccgtgtaccgcgcccgtaaaaacaacctcgccaccgcagcaggacgcgaccagagcggcaacacctactatcgcgccgccaaccaagccaaaacccacggctgggaaatcgaagtcggcggccgcatcacgcccgaatggcagatacaggcaggctacagccaaagcaaaccccgcgaccaagacggcagccgcctgaaccccgacagcgtacccgaacgcagcttcaaactcttcaccgcctaccacttagcccccgaagcccccagcggccggaccatcggtgcgggtgtgcgccggcagggcgaaacccacaccgacccagccgcgctccgcatccccaaccccgccgccaaagcccgcgccgtcgccaacagccgccagaaagcctacgccgtcgccgacatcatggcgcgttaccgcttcaatccgcgcaccgaactgtcgctgaacgtggacaacctgttcaacaaacactaccgcacccagcccgaccgccacagctacggcgcactgcggacagtgaacgcggcgtttacctatcggtttaaataa

SEQ ID NO: 672 - protein, 725 aa, Neisseria gonorrhoeae
MTRFKYSLLFAALLPVYAQADVSVSDDPKPQESTELPTITVTADRTASSNDGYTVSGTHTPFGLPMTLREIPQSVSVITSQQMRDQNIKTLDRALLQATGTSRQIYGSDRAGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 673 - DNA, 366 bp, Neisseria meningitidis
  misc_feature (332)..(332): N= Unknown
  misc_feature (352)..(352): N= Unknown
atgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttnttcaagaatgcgtgccactnagtcgccgacgggg

SEQ ID NO: 674 - protein, 122 aa, Neisseria meningitidis
  misc_feature (111)..(111): Xaa= any amino acid
  misc_feature (118)..(118): Xaa= any amino acid
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPIXSRMRATXSPTG

SEQ ID NO: 675 - DNA, 924 bp, Neisseria meningitidis
atgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaa

SEQ ID NO: 676 - protein, 306 aa, Neisseria meningitidis
MRTAVVLLLIMPMAASSAMMPEMVCAGVSPGTAIISKPTEQTAVMASSLSSVSTPASAAAIIPSSSETGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPNAPAINGLSSTALQNTTILAQPKPSGVISAVRLTVSPASLTASILIPARVLPILMELHTISVVFIASGMERINTSSEGDIPFCTNAEKPPIKDTPMALAALSKVCATLT

SEQ ID NO: 677 - DNA, 924 bp, Neisseria meningitidis
  misc_feature (111)..(111): N= Unknown
  misc_feature (201)..(201): N= Unknown
  misc_feature (610)..(610): N= Unknown
  misc_feature (625)..(625): N= Unknown
  misc_feature (682)..(682): N= Unknown
  misc_feature (810)..(810): N= Unknown
  misc_feature (678)..(678): N= Unknown
atgcgcacggcagtggttttgctgttgatcatgccgatggcggcttcgtcggcaatgatgccggaaatggtgtgcgcgggtgtgtcgccgggaacggcaatcatatccaanccgaccgaacaaacggcggtcatcgcttcgagtttatccaacgtcagcacgcctgcttcggcggcggcaatcataccttcgtcttcgganacggggataaacgcgccactcaaaccgccaaccgcgctcgaagccatcatgccgccctttttcacggcatcgttcagcaatgccaaagctgctgttgtgccgtgcgtaccgcagacgctcaaacccatttcttcaagaatgcgcgccaccgagtcgccgacggcaggggtcggtgccagcgacaagtcgagaataccaaacgggatattcagcatttttgaggcttcgcggccgatgagttcgcccacgcgggtaattttgaaggcggttttcttcacaacttcggcaacttcggtcaatgtcgttgcatccgaattttccaacgcggcttttacgacacccgggccggatacgccgacattaatcacagcatccgcttcgcctgagccgtgaaacgcgcccgccatanacgggttgtcttccnccgcgttgcagaacacgacgattttggcgcagccgaaaccttctagtgtgatttcanccgtgcgtttgatggtttcgcccgccagtctgaccgcgtccatattgataccggcgcgcgtactgccgatattgatggagctgcacacgatatcagtagtcttcatcgcttcgggaatggaacggatnaacacctcgtcagaaggcgacatacctttttgcaccagcgcggaaaagccgccaataaaagacacgccgatggctttggcagccttatccaaagtttgcgccacgctgacgtaa

SEQ ID NO: 678 - protein, 306 aa, Neisseria meningitidis
  misc_feature (37)..(37): Xaa= any amino acid
  misc_feature (67)..(67): Xaa= any amino acid
  misc_feature (203)..(203): Xaa= any amino acid
  misc_feature (208)..(208): Xaa= any amino acid
  misc_feature (227)..(227): Xaa= any amino acid
  misc_feature (269)..(269): Xaa= any amino acid
MRTAVVLLLIMPMAASSAMMPEMVCAGVSPGTAIISXPTEQTAVIASSLSNVSTPASAAAIIPSSSXTGINAPLKPPTALEAIMPPFFTASFSNAKAAVVPCVPQTLKPISSRMRATESPTAGVGASDKSRIPNGIFSIFEASRPMSSPTRVILKAVFFTTSATSVNVVASEFSNAAFTTPGPDTPTLITASASPEPNAPAIXGLSSXALQNTTILAQPKPSSVISXVRLMVSPASLTASILIPARVLPILMELHTISVVFIASGMERXNTSSEGDIPFCTSAEKPPIKDTPMALAALSKVCATLT

SEQ ID NO: 679 - DNA, 924 bp, Neisseria gonorrhoeae
atgcgcacggcggtggttttgctgttgatcatgccgatggcggcttcgtcggcgatgatgccggaaatggtgtgcgcgggcgtgtcgccgggaacggcaatcatgtccaaaccaacggagcagacggcggtcatggcttcgagtttgtccagcgtcaacacgcctgcctcggcggcggcaatcataccttcgtcttcggaaacggggataaacgcgccgctcaaaccgccgaccgcgctggaagccatcatgccgccctttttcacggcatcgttcagcaatgccaaagctgctgttgtgccgtgcgtaccgcagacgctcaagcccatttcttcaagaatgcgcgccaccgagtcgccgacggcgggggtcggtgccagcgacaaatcgagaatgccgaacgggatattcagcatttttgaggcttcgcgaccgatgagttcgcccacgcgggtgattttgaaagcggttttcttcacgacttcggcgacctcggtcaggctgaccgcgtccgaattttccagcgcggctttgaccacgcctggaccggatacgccgacattaatcacagcatccgcttcgcccgagccgtggaacgcacccgccataaacggattgtcttccaccgcgttgcagaacacgacgattttggcgcagccgaaaccttcgggtgtgatttcagccgtgcgtttgatggtttcgcctgccagcttgaccgcatccatattgataccggcacgcgtgctgccgatattgatggagctgcacacgatatcggtagttttcatcgcttcgggaacggaacggatcaacacctcatccgaaggcgacatacctttttgcaccagcgcggaaaagccgccgataaaggacacgccgatggctttggctgccttgtccaaagtctgcgccacgctgacataa

SEQ ID NO: 680 - protein, 307 aa, Neisseria gonorrhoeae
MRTAVVLLLIMPMAASSAMMPEMVCAGVSPGTAIMSKPTEQTAVMASSLSSVNTPASAAAIIPSSSETGINAPLKPPTALEAIMPPFFTASFSNAKAAVVPCVPQTLKPISSRMRATESPTAGVGASDKSRMPNGIFSIFEASRPMSSPTRVILKAVFFTTSATSVRLTASEFSSAALTTPGPDTPTLITASASPEPWNAPAINGLSSTALQNTTILAQPKPSGVISAVRLMVSPASLTASILIPARVLPILMELHTISVVFIASGTERINTSSEGDIPFCTSAEKPPIKDTPMALAALSKVCATLT

SEQ ID NO: 681 - DNA, 183 bp, Neisseria meningitidis
accgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 682 - protein, 60 aa, Neisseria meningitidis
TDVQKELVGEQRKWAQEKISNCRQAAAQADRQEYAEYLKLQCDTRMTRERIQYLRGYSID

SEQ ID NO: 683 - DNA, 1017 bp, Neisseria meningitidis
atgtatcggaaactcattgcgctgccgtttgccctgctgcttgccgcttgcggcagggaagaaccgcccaaggcattggaatgcgccaaccccgccgtgttgcaaggcatacgcggcaatattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaagacggtcagacggcatttgtcgacaacacggtcggtatggcggcgcaaacgctgtctgccgcgctgctgccttacggcgtgaagagcatcgtgatgatagacggcaaggcggtgaaaaaagaagacgcggtcaggattttgagcggaaaagcccgtgaagaagaaccgtccaaacccacgcccgaagacattttggaacacaatgccgccggcggcgatgcgggcgtaccccaagccgcagaaggcgcgcccgaaccggaaatcctgcatcctgacgacggcgagcgtgccgataccgttaccgtatcacggggcgaagtggaagaggcgcgcgtacaaaaccagcgtgcggaatccgaaattaccaaactttggggaggactcgataccgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 684 - protein, 338 aa, Neisseria meningitidis
MYRKLIALPFALLLAACGREEPPKALECANPAVLQGIRGNIQETLTQEARSFAREDGRQFVDADKIIAAAYGLAFSLEHASETQEGGRTFCIADLNITVPSETLADAKANSPLLYGETALSDIVRQKTGGNVEFKDGVLTAAVRFLPVKDGQTAFVDNTVGMAAQTLSAALLPYGVKSIVMIDGKAVKKEDAVRILSGKAREEEPSKPTPEDILEHNAAGGDAGVPQAAEGAPEPEILHPDDGERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 685 - DNA, 1017 bp, Neisseria meningitidis
  misc_feature (106)..(106): N= Unknown
  misc_feature (115)..(115): N= Unknown
  misc_feature (169)..(169): N= Unknown
  misc_feature (173)..(173): N= Unknown
  misc_feature (193)..(193): N= Unknown
  misc_feature (213)..(213): N= Unknown
  misc_feature (215)..(215): N= Unknown
  misc_feature (217)..(218): N= Unknown
  misc_feature (220)..(221): N= Unknown
  misc_feature (223)..(223): N= Unknown
  misc_feature (225)..(225): N= Unknown
  misc_feature (274)..(274): N= Unknown
  misc_feature (458)..(458): N= Unknown
  misc_feature (586)..(586): N= Unknown
  misc_feature (592)..(592): N= Unknown
  misc_feature (595)..(595): N= Unknown
  misc_feature (607)..(607): N= Unknown
  misc_feature (622)..(622): N= Unknown
  misc_feature (625)..(626): N= Unknown
  misc_feature (780)..(780): N= Unknown
  misc_feature (865)..(865): N= Unknown
atgtatcggaaactcattgcgctgccgtttgccctgctgcttgccgcttgcggcagggaagaaccgcccaaggcattggaatgcgccaaccccgccgtgttgcaangcatacgcngcaatattcaggaaacgctcacgcaggaagcgcgttctttcgcgcgcgaagacngcangcagtttgtcgatgccgacnaaattatcgccgccgcctangntnngnngntntctttggaacacgcttcggaaacgcaggaaggcgggcgcacgttctgtntcgccgatttgaacattaccgtgccgtctgaaacgcttgccgatgccaaggcaaacagccccctgctgtacggggaaaccgctttgtcggatattgtgcggcagaagacgggcggcaatgtcgagtttaaagacggcgtattgacggcagccgtccgcttcctacccgtcaaagacggtcaganggcatttgtcgacaacacggtcggtatggcggcgcaaacgctgtctgccgcgttgctgccttacggcgtgaagagcatcgtgatgatagacggcaaggcggtaaaaaaagaagacgcggtcaggattntgagcnganaagcccgtgaanaagaaccgtccaaanccnngcccgaagacattttggaacataatgccgccggaggggatgcagacgtaccccaagccggagaagacgcgcccgaaccggaaatcctgcatcctgacgacggcgagcgtgccgataccgttaccgtatcacggggcgaagtggaagaggcgcgngtacaaaaccagcgtgcggaatccgaaattaccaaactttggggaggactcgataccgacgtgcaaaaagagttggtcggcgaanaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattag

SEQ ID NO: 686 - protein, 338 aa, Neisseria meningitidis
  misc_feature (36)..(36): Xaa= any amino acid
  misc_feature (39)..(39): Xaa= any amino acid
  misc_feature (57)..(58): Xaa= any amino acid
  misc_feature (65)..(65): Xaa= any amino acid
  misc_feature (71)..(75): Xaa= any amino acid
  misc_feature (92)..(92): Xaa= any amino acid
  misc_feature (153)..(153): Xaa= any amino acid
  misc_feature (196)..(196): Xaa= any amino acid
  misc_feature (198)..(199): Xaa= any amino acid
  misc_feature (203)..(203): Xaa= any amino acid
  misc_feature (208)..(209): Xaa= any amino acid
  misc_feature (289)..(289): Xaa= any amino acid
MYRKLIALPFALLLAACGREEPPKALECANPAVLQXIRXNIQETLTQEARSFAREDXXQFVDADXIIAAAXXXXXSLEHASETQEGGRTFCXADLNITVPSETLADAKANSPLLYGETALSDIVRQKTGGNVEFKDGVLTAAVRFLPVKDGQXAFVDNTVGMAAQTLSAALLPYGVKSIVMIDGKAVKKEDAVRIXSXXAREXEPSKXXPEDILEHNAAGGDADVPQAGEDAPEPEILHPDDGERADTVTVSRGEVEEARVQNQRAESEITKLWGGLDTDVQKELVGEXRKWAQEKISNCRQAAAQADRQEYAEYLKLQCDTRMTRERIQYLRGYSID

SEQ ID NO: 687 - DNA, 1017 bp, Neisseria gonorrhoeae
atgtatcggaaactcattgcgctgccgtttgccctgctgcttgcagcgtgcggcagggaagaaccgcccaaggcgttggaatgcgccaaccccgccgtgttgcaggacatacgcggcagtattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccgaggcaaacagccccctgctgtatggggaaacgtctttggcagacatcgtgcagcagaagacgggcggcaatgtcgagtttaaagacggcgtattgacggcagccgtccgcttcctgcccgccaaagacgctcggacggcatttatcgacaacacggtcggtatggcgacgcaaacgctgtctgccgcgttgctgccttacggcgtgaagagcatcgtgatgatagacggcaaggcggtgacaaaagaagacgcggtcagggttttgagcggcaaagcccgtgaagaagaaccgtccaaacccacccccgaagacattttggaacacaatgccgccggcggcgatgcgggcgtaccccaagccgcagaaggcgcacccgaacccgaaatcctgcatcccgacgacgtcgagcgtgccgataccgttaccgtatcacggggcgaagtggaagaggcgcgcgtacaaaaccaacgtgcggaatccgaaattaccaaactttggggaggactcgataccgacgtgcaaaaagagttggtcggcgaacagcgcaagtgggcgcaggaaaaaatcagcaactgccgacaagccgccgcgcaggcagaccggcaggaatacgccgaatacctcaagctccaatgcgacacgcggatgacgcgcgaacggatacagtatcttcgcggctattccatcgattag

SEQ ID NO: 688 - protein, 338 aa, Neisseria gonorrhoeae
MYRKLIALPFALLLAACGREEPPKALECANPAVLQDIRGSIQETLTQEARSFAREDGRQFVDADKIIAAAYGLAFSLEHASETQEGGRTFCIADLNITVPSETLADAEANSPLLYGETSLADIVQQKTGGNVEFKDGVLTAAVRFLPAKDARTAFIDNTVGMATQTLSAALLPYGVKSIVMIDGKAVTKEDAVRVLSGKAREEEPSKPTPEDILEHNAAGGDAGVPQAAEGAPEPEILHPDDVERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 689 - DNA, 909 bp, Neisseria meningitidis
atgcagctgatcgactattcacattcatttttctcggttgtgccaccctttttggcactggcacttgccgtcattacccgccgcgtactgctgtctttaggcatcggtattctggwysgcgttgcctttttggtcggcggcaaccccgtcgacggtctgacacacctgaaagacatggtcgtcggcttggcttggtcagacgsygattggtcgctgggcaaaccaaaaatcttggttttcckgatacttttgggtatttttacttccctgctgacctactccggcagcaatacttcgctggtattcggcggcacttgcggcgtctttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaa

SEQ ID NO: 690 - protein, 303 aa, Neisseria meningitidis
  misc_feature (39)..(40): Xaa= any amino acid
  misc_feature (68)..(68): Xaa= any amino acid
  misc_feature (81)..(81): Xaa= any amino acid
MQLIDYSHSFFSVVPPFLALALAVITRRVLLSLGIGILXXVAFLVGGNPVDGLTHLKDMVVGLAWSDXDWSLGKPKILVFXILLGIFTSLLTYSGSNTSLVFGGTCGVFAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKK

SEQ ID NO: 691 - DNA, 1521 bp, Neisseria meningitidis
atgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaaatcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgattgcccgccccgttaccgacaagtttaaagtttcccgcaccaaactcgcctacatcctcgactccactgccgctcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttttccttcgacatcggctcgatggcacgtttcgaacaagccgcgttgaacgaagcccacgatgaaactgccgtttcagacgctaccaaaggtcgtgtttacgcactgattattcccgttttggccttaatcgcctcaacggtttccgccatgatctacaccggcgcgcaggcaagcgaaaccttcagcattttgggggcatttgaaaacacggacgtaaacacttcgctggtattcggcggcacttgcggcgtccttgccgtcgttctctgcacgctcggcacgattaaaaccgccgactatcccaaagccgtttggcagggtgcgaaatctatgttcggcgcaatcgccattttaatcctcgcttggctcatcagtacggttgtcggcgaaatgcacaccggcgattacctctccacactggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgctcgcccatttccgacacgaccatcctgtcgtccaccggcgcgcgctgcaaccacatcgaccacgttacctcgcaactgccttacgccttaaccgttgccgccgccgccgcatcgggctacctcgcattgggtctgacaaaatccgcgctgttgggctttggcacgacaggcattgtattggcggtgctgatttttctgttgaaagataaaaaacgcgccaacgcctga

SEQ ID NO: 692 - protein, 506 aa, Neisseria meningitidis
MQLIDYSHSFFSVVPPFLALALAVITRRVLLSLGIGILVGVAFLVGGNPVDGLTHLKDMVVGLAWSDGDWSLGKPKILVFLILLGIFTSLLTYSGSNQAFADWAKRHIKNRRGAKMLTACLVFVTFIDDYFHSLAVGAIARPVTDKFKVSRTKLAYILDSTAAPMCVLMPVSSWGASIIATLAGLLVTYKITEYTPMGTFVAMSLMNYYALFALIMVFVVAWFSFDIGSMARFEQAALNEAHDETAVSDATKGRVYALIIPVLALIASTVSAMIYTGAQASETFSILGAFENTDVNTSLVFGGTCGVLAVVLCTLGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRANA

SEQ ID NO: 693 - DNA, 1521 bp, Neisseria meningitidis
  misc_feature (229)..(229): N= Unknown
  misc_feature (415)..(415): N= Unknown
  misc_feature (1120)..(1120): N= Unknown
  misc_feature (1362)..(1362): N= Unknown
  misc_feature (1410)..(1410): N= Unknown
  misc_feature (1457)..(1457): N= Unknown
atgcagctgatcgactattcacattcatttttctcggttgtgccaccctttttggcactggcacttgccgtcattacccgccgcgtactgctgtctttaggcatcggtattctggtcggcgttgcctttttggtcggcggcaaccccgtcgacggtctgacacacctgaaagacatggtcgtcggcttggcttggtcagacggcgattggtcgctgggcaaaccaaaantcttggttttcctgatacttttgggtatttttacttccctgctgacctactccggcagcaatcaggcgtttgccgactgggcaaaacggcacattaaaaaccggcgcggcgcgaaaatgctgaccgcctgcctcgtgttcgtaacctttatcgacgactatttccacagtctcgccgtcggtgcgnttgcccgccccgttaccgacaagtttaaagtttcccgcgccaaactcgcctacatcctcgactccactgccgcgcctatgtgcgtgctgatgcccgtttcaagctggggcgcgtcgattatcgccacgcttgccggactgctcgttacctacaaaatcaccgaatacacgccgatggggacgtttgtcgccatgagcctgatgaactattacgcactgtttgccctgattatggtgttcgtcgtcgcatggttctccttcgacatcggctcgatggcacgtttcgaacaagccgcgttgaacgaagcccacgatgaaactgccgtttcagacggcagctggggcagggtttacgcattgattattcccgttttggccttaatcgcctcaacggtttccgccatgatctacaccggtgcacaggcaagcgaaaccttcagcattttgggtgcatttgaaaatacggacgtgaacacttcgctggtattcggcggcacttgcggcgtgcttgccgtcgtcctctgcacgctcggcacgattaaaatcgccgattatcccaaagccgtttggcagggtgcgaaatccatgttcggcgcaatcgccattttaatccttgcctggctcatcagtacggttgtcggcgaaatgcacacaggcgactacctctccacgctggttgcgggcaacatccatcccggcttcctgnccgtcatccttttcctgctcgccagcgtgatggcgtttgccacaggcacaagctgggggacgttcggcatcatgctgccgattgccgccgccatggcggtcaaagtcgatccctcactgattatcccgtgtatgtccgccgtgatggcgggggcggtatgcggcgaccactgctcgcccatttccgacacgaccatcctgtcgtccaccggcgcgcgctgcaaccacatcgaccacgttacntcgcaactgccttacgccttaaccgttgccgccgccgccgcatcgggntacctcgcattgggtctgacaaaatccgcgctgttgggttttggcangacaggcattgtattggcggtgctgatttttctgttgaaagataaaaaacgcgccaacgcctga

SEQ ID NO: 694 - protein, 506 aa, Neisseria meningitidis
  misc_feature (77)..(77): Xaa= any amino acid
  misc_feature (139)..(139): Xaa= any amino acid
  misc_feature (374)..(374): Xaa= any amino acid
  misc_feature (486)..(486): Xaa= any amino acid
MQLIDYSHSFFSVVPPFLALALAVITRRVLLSLGIGILVGVAFLVGGNPVDGLTHLKDMVVGLAWSDGDWSLGKPKXLVFLILLGIFTSLLTYSGSNQAFADWAKRHIKNRRGAKMLTACLVFVTFIDDYFHSLAVGAXARPVTDKFKVSRAKLAYILDSTAAPMCVLMPVSSWGASIIATLAGLLVTYKITEYTPMGTFVAMSLMNYYALFALIMVFVVAWFSFDIGSMARFEQAALNEAHDETAVSDGSWGRVYALIIPVLALIASTVSAMIYTGAQASETFSILGAFENTDVNTSLVFGGTCGVLAVVLCTLGTIKIADYPKAVWQGAKSMFGAIAILILAWLISTVVGEMHTGDYLSTLVAGNIHPGFLXVILFLLASVMAFATGTSWGTFGIMLPIAAAMAVKVDPSLIIPCMSAVMAGAVCGDHCSPISDTTILSSTGARCNHIDHVTSQLPYALTVAAAAASGYLALGLTKSALLGFGXTGIVLAVLIFLLKDKKRANA

SEQ ID NO: 695 - DNA, 1521 bp, Neisseria gonorrhoeae
atgcagctgattgactattcacattcatttttctcggttgtgccaccctttttggcactggcacttgccgtcattacccgccgcgtactgctgtctttaggcatcggtattttggtcggcgttgcctttttggtcggcggcaaccccgtcgacggtctgacacacctgaaagacatggtcgtcggcttggcttgggcagacggcgattggtcgctgggcaaaccaaaaatcttggttttcctgatacttttgggcattttcacttcactgctgacctactccggcagcaatcaggcgtttgccgactgggcaaaacggcacattaaaaaccggtgcggcgcgaaaatgctgaccgcctgcctcgtgttcgtaacctttatcgacgactatttccacagcctcgccgtcggtgcgattgcccgccccgttaccgacaagtttaaagtttcccgcgccaaactcgcctacatcctcgactccactgcctcgcccatgtgcgtgctgatgcccgtttcaagctggggcgcgtcgattatcgccacgcttgccggattgctcgttacctacaaaattaccgaatacacgccgatggggacgtttgtcgccatgagcctgatgaactattacgcgctgtttgccctgattatggtattcgtcgtcgcatggttctccttcgacatcggctcgatggcgcgtttcgaacaggctgcgttgaacgaagcccaggacgaaaccgccgcttcagacgctaccaaaggtcgtgtttacgcattgattattcccgttttggccttaatcgcctcaacggtttccgccatgatctacaccggcgcgcaggcaagcgaaaccttcagcattttgggggcatttgaaaataccgacgtaaacacttcgctggtattcggcggcacttgcggcgtgcttgccgtcgtcctctgcacgttcggcacgattaaaaccgccgattatcccaaagccgtgtggcagggtgcgaaatccatgttcggcgcaatcgccattttaatcctcgcctggctcatcagtacggttgtcggcgaaatgcacacgggcgactacctctccacgctggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgttcgcccatctccgacacgaccatcctgtcgtccaccggcgcgcgctgcaaccacatcgaccacgttacctcgcaactgccttatgccctgacggttgccgccgccgccgcatcgggctacctcgcattgggtctgacaaaatccgcgctgttgggctttggcacgaccggtattgtattggcggtgctgatttttctgttgaaagataaaaaacgcgccgacgtttga

SEQ ID NO: 696 - protein, 506 aa, Neisseria gonorrhoeae
MQLIDYSHSFFSVVPPFLALALAVITRRVLLSLGIGILVGVAFLVGGNPVDGLTHLKDMVVGLAWADGDWSLGKPKILVFLILLGIFTSLLTYSGSNQAFADWAKRHIKNRCGAKMLTACLVFVTFIDDYFHSLAVGAIARPVTDKFKVSRAKLAYILDSTASPMCVLMPVSSWGASIIATLAGLLVTYKITEYTPMGTFVAMSLMNYYALFALIMVFVVAWFSFDIGSMARFEQAALNEAQDETAASDATKGRVYALIIPVLALIASTVSAMIYTGAQASETFSILGAFENTDVNTSLVFGGTCGVLAVVLCTFGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRADV

SEQ ID NO: 697 - DNA, 247 bp, Neisseria meningitidis
  misc_feature (20)..(20): N= Unknown
aagcaatggtatgccgacgnagtatcaagacggaaatggttatggtcaacgatgagcctgccaaaattctgacttgggatgaaagcggccgattactctcggaactgtctatccgccaccatcaacgcaacggggtggttttggagtggtatgaagatggttctaaaaagagcgaagtgtttatcaggatgacaagttggtcaggaaaacccagtgggataaggatggttatttaatcgaaccctga

SEQ ID NO: 698 - protein, 82 aa, Neisseria meningitidis
  misc_feature (7)..(7): Xaa= any amino acid
  misc_feature (60)..(60): Xaa= any amino acid
KQWYADXSIKTEMVMVNDEPAKILTWDESGRLLSELSIRHHQRNGVVLEWYEDGSKKSEXVYQDDKLVRKTQWDKDGYLIEP

SEQ ID NO: 699 - DNA, 738 bp, Neisseria meningitidis
atgaaaaaattatctcggattgtattttcaactgtcctgttgggtttttcggccgctttgccggcgcagacctattctgtttattttaatcagaacggaaagctgacggcgacgatgtcttctgccgcttatatcaggcaatatagtgtggtggcgggtattgcgcacgcgcaggatttttattatccgtcgatgaagaaatattctgaaccttatatcgttgcttcaacgcaaatcaaatcttttgtgcctaccctgcaaaacggtatgttgattttgtggcattttaatggtcagaaaaaaatggcggggggcttcagcaagggtaagccggacggggagtgggtcaactggtatccgaacggtaaaaaatctgccgttatgccttataaaaatggcttgagtgagggtacgggataccgctattaccgtaacggcggcaaggaaagcgaaatccagtttaagcaaaataaggcaaacggcgtatggaagcaatggtatgccgacggcagtatcaagacggaaatggttatggtcaacgatgagcctgccaaaattctgacttgggatgaaagcggccgattactctcggaactgtctatccgccaccatcaacgcaacggggtggttttggagtggtatgaagatggttctaaaaagagcgaagctgtttatcaggatgacaagttggtcaggaaaacccagtgggataaggatggttatttaatcgaaccctga

SEQ ID NO: 700 - protein, 245 aa, Neisseria meningitidis
MKKLSRIVFSTVLLGFSAALPAQTYSVYFNQNGKLTATMSSAAYIRQYSVVAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHQRNGVVLEWYEDGSKKSEAVYQDDKLVRKTQWDKDGYLIEP

SEQ ID NO: 701 - DNA, 738 bp, Neisseria meningitidis
  misc_feature (71)..(71): N= Unknown
  misc_feature (115)..(115): N= Unknown
  misc_feature (129)..(129): N= Unknown
  misc_feature (177)..(177): N= Unknown
  misc_feature (183)..(183): N= Unknown
  misc_feature (291)..(291): N= Unknown
  misc_feature (309)..(309): N= Unknown
  misc_feature (419)..(420): N= Unknown
  misc_feature (613)..(613): N= Unknown
  misc_feature (662)..(662): N= Unknown
  misc_feature (714)..(714): N= Unknown
atgaaaaaattatctcggattgtattttcaactgtcctgttgggtttttcggccgctttgccggcgcaganctattctgtttattttaatcagaacgggaaactgacggcgacgntgtcttctgccgcntatatcaggcaatatagtgtggcggagggtattgcgcacgcgcagganttttantatccgtcgatgaagaaatattccgaaccttatatcgttgcttcaacgcaaatcaaatcttttgtgcctaccctgcaaaacggtatgttgattttgtggcattttaanggtcagaaaaaaatggcngggggcttcagcaagggtaagccggacggggagtgggtcaactggtatccgaacggtaaaaaatctgccgttatgccttataaaaatggtttgagtgaaggtacggggtnncgctattaccgtaacggcggcaaggaaagcgaaatccagtttaaacagaataaggcaaacggcgtatggaagcaatggtatgccgacggcaatatcaaaacggaaatggttatggtcaatgatgagcctgccaaaattctgacatgggatgaaagcggtcgattactctcggaactgtctatccatcatcatnaacgtaatggagtagtcttagagtggtatgaagatggttctaaaaagantgaagctgtttatcaggatgataagttggtcaggaaaacccagtgggataangatggttatttaatcgaaccctga

SEQ ID NO: 702 - protein, 245 aa, Neisseria meningitidis
  misc_feature (24)..(24): Xaa= any amino acid
  misc_feature (39)..(39): Xaa= any amino acid
  misc_feature (59)..(59): Xaa= any amino acid
  misc_feature (61)..(61): Xaa= any amino acid
  misc_feature (97)..(97): Xaa= any amino acid
  misc_feature (140)..(140): Xaa= any amino acid
  misc_feature (205)..(205): Xaa= any amino acid
  misc_feature (221)..(221): Xaa= any amino acid
  misc_feature (238)..(238): Xaa= any amino acid
MKKLSRIVFSTVLLGFSAALPAQXYSVYFNQNGKLTATXSSAAYIRQYSVAEGIAHAQXFXYPSMKKYSEPYIVASTQIKSFVPTLQNGMLILWHFXGQKKMAGGFSKGKPDGEWVNWYPNGKKSAVMPYKNGLSEGTGXRYYRNGGKESEIQFKQNKANGVWKQWYADGNIKTEMVMVNDEPAKILTWDESGRLLSELSIHHHXRNGVVLEWYEDGSKKXEAVYQDDKLVRKTQWDXDGYLIEP

SEQ ID NO: 703 - DNA, 738 bp, Neisseria gonorrhoeae
atgaagaaattatctcggattgtattttcaatcgtactgttgggtttttcggccgctttgccggcgcagacctattctgtttattttaatcagaacgggaaactgacggcgacgatgtcttctgccgcttatatcaggcaatatagtgtggcggcgggtatcgcacacgcgcaggatttttattatccgtcgatgaagaaatattccgaaccttatatcgttgcttcaacgcaaatcaaatcttttgtgcctaccctgcaaaacggtatgttgattttgtggcattttaatggtcagaaaaaaatggcggggggcttcagcaagggtaagccggacggggaatgggtcaactggtatccgaacggtaaaaaatctgcggttatgccttataaaaatggcttgagtgagggtacgggataccgttattaccgtaacggcggcaaggaaagcgaaatccagtttaagcaaaataaggcgaacggcgtatggaagcaatggtatgccgatggaagtatcaagacggaaatggttatggtcaacgatgagcctgccaaaattctgacttgggatgaaagcggccgattactttcggaactgtctatccgccaccataaacgcaacggggtggttttggagtggtatgaagatggttctaaaaagagcgaggctgtttatcaggatgacaagttggtcaggaaaacccaatgggataaggatggttatttaatcgaaccctga

SEQ ID NO: 704 - protein, 245 aa, Neisseria gonorrhoeae
MKKLSRIVFSIVLLGFSAALPAQTYSVYFNQNGKLTATMSSAAYIRQYSVAAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHKRNGVVLEWYEDGSKKSEAVYQDDKLVRKTQWDKDGYLIEP

SEQ ID NO: 705 - DNA, 517 bp, Neisseria meningitidis
atgaaatttaccaagcaccccgtctgggcaatggcgttccgcccattttattcgctggcggctctgtacggcgcattgtccgtattgctgtggggtttcggctacacgggaacgcackagctgtccggtttctattggcacgcgcatgagatgatttggggttatgccggactggtcgtcatcgccttcctgctgaccgccgtcgccacttggacggggcagccgcccacgcggggcggcgtatctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatg

SEQ ID NO: 706 - protein, 172 aa, Neisseria meningitidis
  misc_feature (40)..(40): Xaa= any amino acid
MKFTKHPVWAMAFRPFYSLAALYGALSVLLWGFGYTGTHXLSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVM

SEQ ID NO: 707 - DNA, 1155 bp, Neisseria meningitidis
atgaaatttaccaagcaccccgtctgggcaatggcgttccgcccattttattcgctggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatggtgtcgggttttatcggtctgattggtacgcggattatttcgttttttacgtccaaacgcttgaatgtgccgcagattcccagtccgaaatgggtggcgcaggcttcgctgtggctgcccatgctgactgccatgctgatggcgcacggtgtgttggcttggctgtctgccgtttttgcctttgcggcaggtgtgatttttaccgtgcaggtgtaccgctggtggtataaacccgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgcttggtcatacgggcaatccgatttatccgccgcccaaagccgttcccgttgcgttttggctgatgatggcggcaaccgccgtccgtatggttgccgtattttcttccggcactgcctacacgcacagcatccgcacctcttcggttttgtttgcactcgcgcttttggtgtatgcgtggaagtatattccttggctgattcgtccgcgttcggacggcaggcccggttga

SEQ ID NO: 708 - protein, 384 aa, Neisseria meningitidis
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVLAWLSAVFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 709 - DNA, 1155 bp, Neisseria meningitidis
atgaaatttaccaagcaccccgtttgggcaatggcgttccgcccgttttattcactggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaattatgttgccgtgttcgcgctgttcgtcttgggcggtacgcacgcggcgttccacgtccagctgcacaacggcaacctaggcggactcttgagcggattgcagtcgggcttggtgatggtgtcgggttttatcggtctgattggtacgcggattatttcgttttttacgtccaaacggttgaatgtgccgcagattcccagtccgaaatgggtggcgcaggcttcgctgtggctgcccatgctgaccgccatgctgatggcgcacggcgtgatgccttggctgtcggcggctttcgcgtttgcggcaggtgtgatttttaccgtgcaggtgtaccgctggtggtataagcctgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgctcggtcatacgggcaatccgatttatccgccgcccaaagccgttcccgttgcgttttggctgatgatggcggcaaccgccgtccgtatggttgccgtattttcttccggcactgcctacacgcacagcatacgcacctcttcggttttgtttgcactcgcgcttttggtgtatgcgtggaagtatattccttggctgattcgtccgcgttcggacggcaggcccggttga

SEQ ID NO: 710 - protein, 384 aa, Neisseria meningitidis
MKFTKHPVWAMAFRPFYSLAALYGALSVLLWGFGYTGTHELSGFYWHAHEMIWGYAGLVVIAFLLTAVATWTGQPPTRGGVLVGLTIFWLAARIAAFIPGWGASASGILGTLFFWYGAVCMALPVIRSQNQRNYVAVFALFVLGGTHAAFHVQLHNGNLGGLLSGLQSGLVMVSGFIGLIGTRIISFFTSKRLNVPQIPSPKWVAQASLWLPMLTAMLMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNPIYPPPKAVPVAFWLMMAATAVRMVAVFSSGTAYTHSIRTSSVLFALALLVYAWKYIPWLIRPRSDGRPG

SEQ ID NO: 711 - DNA, 8 bp, Neisseria gonorrhoeae
  misc_feature (1)..(8): N = Unknown
nnnnnnnn

SEQ ID NO: 712 - protein, 271 aa, Neisseria gonorrhoeae
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVWGFIGLIGMKIISFFTSKRLKLPQIPSPKWVAHASLWLPMLNAILMAHRVMPWLSAAFPFAAGVIFTVQVYAGGITPIEETSCGSVAGICYRLGNSSG

SEQ ID NO: 713 - DNA, 1155 bp, Neisseria gonorrhoeae
atgaaatttaccaaacatcccgtctgggcaatggcgttccgcccgttttattcactggcggcactgtacggcgcattgtccgtattgctgtggggtttcggctacacgggaacgcacgagctgtccggtttctattggcacgcgcatgagatgatttggggttatgccggtctcgtcgtcatcgccttcctgctgaccgccgtcgccacttggacgggacagccgcccacgaggggcggcgttctggtcggcttgaccgccttttggctggctgcgcggattgccgcctttatcccgggttggggtgcggcggcaagcggcatactcggtacgctgtttttctggtacggcgcggtgtgcatggctttgcccgttatccgttcgcaaaaccggcgcaactatgtcgccgtattcgcaatatttgtgctgggcggtacgcatgcggcgttccacgtccagctgcacaacggcaacctaggcggactcttgagcggattgcagtcgggcctggttatggtgtcgggctttatcggcctgattgggatgaggattatttcgttttttacgtccaaacggttgaacgtgccgcagattcccagtccgaaatgggtggcgcaggcttcgctgtggctacccatgctgaccgccatactgatggcgcacggcgtgatgccttggctgtcggcggctttcgcgtttgcggcgggcgtgatttttaccgtacaggtgtaccgctggtggtataaacccgtattgaaagaaccgatgctgtggattctgtttgccggctatctgtttaccggattggggctgattgcggtcggcgcgtcttatttcaaacctgccttcctcaatctgggcgtacatctgatcggggtcggcggtatcggcgtgctgactttgggcatgatggcgcgtaccgcgctcggtcatacgggcaattcgatttatccgccgcccaaagccgttcccgttgcgttttggctgatgatggcggcaaccgccgtccgtatggttgccgtattttcttccggcactgcctacacgcacagcatccgcacgtcttcggttttgtttgcactcgcgctgctggtgtatgcgtggaaatacattccgtggctgatccgtccgcgttcggacggcaggcccggttga

SEQ ID NO: 714 - protein, 384 aa, Neisseria gonorrhoeae
MKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVSGFIGLIGMRIISFFTSKRLNVPQIPSPKWVAQASLWLPMLTAILMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNSIYPPPKAVPVAFWLMMAATAVRMVAVFSSGTAYTHSIRTSSVLFALALLVYAWKYIPWLIRPRSDGRPG

SEQ ID NO: 715 - DNA, 570 bp, Neisseria meningitidis
atgccgtctgaaggttcagacggcmtcggtgycggggaaycagaagyggtagcgcatgcccaatgagacttcgtgggttttgaagcgggtgttttccaagcgtccccagttgtggtaacggtatccggtgtcyaargtcagcttgggygtgatgtcgaaaccgacaccggcgatgacaccaagaccyamgctgctgatrctgtkgctttcgtgataggsaggtttgytggkmksasyttgtayratwkkgcctsscwstgkagmgccktkckytggtkkaswgrwartagtcgtggtttytkttyycaccgaatgaacytgatgtttaacgtgtccgtaggcgacgcgcgcgccgatatagggtttgaatttatcgttgagtttgaaatcgtaaatggcggacaagccgagagaagaaacggcgtggaagctgccgtttccctgatgttttgtttgggtttctttgtagttgttgtttatctcttcagtaacttttttagtagaagaattactttctttccattttctgtaactggcataatctgccgctattctccagccgccgaaatc

SEQ ID NO: 716 - protein, 190 aa, Neisseria meningitidis
  misc_feature (9)..(9): Xaa= any amino acid
  misc_feature (11)..(11): Xaa= any amino acid
  misc_feature (14)..(14): Xaa= any amino acid
  misc_feature (16)..(16): Xaa= any amino acid
  misc_feature (22)..(22): Xaa= any amino acid
  misc_feature (45)..(46): Xaa= any amino acid
  misc_feature (50)..(50): Xaa= any amino acid
  misc_feature (63)..(63): Xaa= any amino acid
  misc_feature (67)..(67): Xaa= any amino acid
  misc_feature (76)..(76): Xaa= any amino acid
  misc_feature (78)..(79): Xaa= any amino acid
  misc_feature (82)..(83): Xaa= any amino acid
  misc_feature (85)..(88): Xaa= any amino acid
  misc_feature (90)..(91): Xaa= any amino acid
  misc_feature (93)..(96): Xaa= any amino acid
  misc_feature (101)..(102): Xaa= any amino acid
MPSEGSDGXGXGEXEXVAHAQXDFVGFEAGVFQASPVVVTVSGVXXQLGXDVETDTGDDTKTXAADXVAFVIGRFXGXXLYXXAXXXXAXXWXXXXSRGFXXHRMNLMFNVSVGDARADIGFEFIVEFEIVNGGQAERRNGVEAAVSLMFCLGFFVVVVYLFSNFFSRRITFFPFSVTGIICRYSPAAEI

SEQ ID NO: 717 - DNA, 8 bp, Neisseria gonorrhoeae
  misc_feature (1)..(8): N = Unknown
nnnnnnnn

SEQ ID NO: 718 - protein, 360 aa, Neisseria gonorrhoeae
MPSETVGSIVNVGVDESVGFSPPFPSIQHFYRFHRIHRIRLFRPPGPMQLNRHSHGSGNLGRGVWATVLSDKFPCGQVRIPACAGMTNFEIAVLSGMTVRVFYCARPAPVNGGRLKMPSEGSDGIGIGESEAVAHAQRGFVGFEAGVFQASPVVVAVAGVQGQAGRDVYAHARHRAEAQAAAAVAFLIGVFLRMSVRINRNCCVSITRVGGKSTCYFFSRIDAVSDVSVGDARTDIGFEFVVEFEIVNGGQAERRNGVECAVFLMFRLLVFYVKLVAAKSFIILSFQLFYVHGIFIVVPFPVTGIIRGDAPAAEVVADRHPGVDGMRTDVSEIIAYRAYFVFAWSGWFRIIVGNAFGGVG

SEQ ID NO: 719 - DNA, 435 bp, Neisseria meningitidis
atgtttgcttttttagaagccttttttgtcgaatacggttatgcggctgttttttttgtattggtcatctgcggtttcggcgtgccgattcccgaggatttgaccttggtaacaggcggcgtgatttcgggtatgggttataccaatccgcatattatgtttgcagtcggtatgctcggcgtattggtcggggacggcatcatgttcgccgccggacgaatttgggggcagarartcctarggttcaracctattgcgsgcatcatgacgccgraacgttatgagcaggttcaggaaaaattcgacaaatacggtaactgggtcttatttgtcgcccgtttcctgcccggtttgagaacggccgtatttgttacagccggtatcagccgcaaggtttcatacttgcgttttatcattatggatggactggccgca

SEQ ID NO: 720 - protein, 145 aa, Neisseria meningitidis
  misc_feature (78)..(79): Xaa= any amino acid
  misc_feature (81)..(81): Xaa= any amino acid
  misc_feature (83)..(83): Xaa= any amino acid
  misc_feature (87)..(87): Xaa= any amino acid
  misc_feature (92)..(92): Xaa= any amino acid
MFAFLEAFFVEYGYAAVFFVLVICGFGVPIPEDLTLVTGGVISGMGYTNPHIMFAVGMLGVLVGDGIMFAAGRIWGQXXLXFXPIAXIMTPXRYEQVQEKFDKYGNWVLFVARFLPGLRTAVFVTAGISRKVSYLRFIIMDGLAA

SEQ ID NO: 721 - protein, 684 aa, Neisseria meningitidis
ATGTTTGCTTTTTTAGAAGCCTTTTTTGTCGAATACGGTTATGCGGCTGTTTTTTTTGTATTGGTCATCTGCGGTTTCGGCGTGCCGATTCCCGAGGATTTGACCTTGGTAACAGGCGGCGTGATTTCGGGTATGGGTTATACCAATCCGCATATTATGTTTGCAGTCGGTATGCTCGGCGTATTGGTCGGGGACGGCATCATGTTCGCCGCCGGACGAATTTGGGGGCAGAAAATCCTAAGGTTCAAACCTATTGCGCGCATCATGACGCCGAAACGTTATGAGCAGGTTCAGGAAAAATTCGACAAATACGGTAACTGGGTCTTATTTGTCGCCCGTTTCCTGCCCGGTTTGAGAACGGCCGTATTTGTTACAGCCGGTATCAGCCGCAAGGTTTCATACTTGCGTTTTATCATTATGGATGGACTGGCCGCACTGATTTCCGTCCCTATTTGGATTTATCTGGGCGAATACGGTGCGCACAACATCGATTGGCTGATGGCGAAAATGCACAGCCTGCAATCGGGTATTTTTGTTATCTTGGGTATAGGTGCGACCGTTGTCGCTTGGATTTGGTGGAAAAAACGCCAACGTATCCAGTTTTACCGCAGCAAATTGAAAGAAAAGCGGGCGCAACGCAAAGCCGCCAAGGCAGCCAAAAAAGCCGCGCAAAGCAAACAATAA

SEQ ID NO: 722 - protein, 227 aa, Neisseria meningitidis
MFAFLEAFFVEYGYAAVFFVLVICGFGVPIPEDLTLVTGGVISGMGYTNPHIMFAVGMLGVLVGDGIMFAAGRIWGQKILRFKPIARIMTPKRYEQVQEKFDKYGNWVLFVARFLPGLRTAVFVTAGISRKVSYLRFIIMDGLAALISVPIWIYLGEYGAHNIDWLMAKMHSLQSGIFVILGIGATVVAWIWWKKRQRIQFYRSKLKEKRAQRKAAKAAKKAAQSKQ

SEQ ID NO: 723 - DNA, 684 bp, Neisseria meningitidis
atgtttgcccttttggaagccttttttgtcgaatacggctatgcggccgtgtttttcgttttggtcatctgcggtttcggcgtgccgattcccgaggatttgaccttggtaacaggcggcgtgatttcgggtatgggttataccaatccgcatattatgtttgcagtcggtatgctcggcgtattggtcggggacggcatcatgttcgccgccggacgcatctgggggcagaaaatcctcaagttcaaaccgattgcgcgcatcatgacgccgaaacgttacgcacaggttcaggaaaaattcgacaaatacggcaactgggtgttatttgtcgctcgtttcctgcccggtttgcggactgccgttttcgttaccgccggcatcagccgcaaagtatcgtatctgcgctttctgattatggacgggcttgccgcgctgatttccgtgcccgtttggatttacttgggcgagtacggcgcgcacaacatcgattggctgatggcgaaaatgcacagcctgcaatccggcatcttcatcgcattgggcgtgctggcggcggcgctggcgtggttctggtggcgcaaacgccgacattatcagctttaccgcgcacaattgagcgaaaaacgcgccaaacgcaaggcggaaaaggcagcgaaaaaagcggcacagaagcagcagtaa

SEQ ID NO: 724 - protein, 227 aa, Neisseria meningitidis
MFALLEAFFVEYGYAAVFFVLVICGFGVPIPEDLTLVTGGVISGMGYTNPHIMFAVGMLGVLVGDGIMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 725 - DNA, 8 bp, Neisseria gonorrhoeae
  misc_feature (1)..(8): N = Unknown
nnnnnnnn

SEQ ID NO: 726 - protein, 122 aa, Neisseria gonorrhoeae
YPVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 727 - DNA, 684 bp, Neisseria gonorrhoeae
atgtttgcccttttggaagccttttttgtcgaatacggctatgcggccgtgtttttcgttttggtcatctgcggtttcggcgtgccgattcccgaagatttgaccttggtaacgggcggcgtgatttcgggtatgggttataccaatccgcatattatgtttgcggtcggtatgctcggcgtgttggcgggcgacggcgtgatgtttgccgccggacgcatctgggggcagaaaatcctcaagttcaaaccgattgcgcgcatcatgacgccgaaacgttacgcgcaggttcaggaaaaattcgacaaatacggcaactgggttctgtttgtcgcccgtttcctgccgggtttgcggactgccgttttcgttaccgccggcatcagccgcaaagtatcgtatctgcgctttctgattatggacgggctggccgcgctgatttccgtgcccgtttggatttacttgggcgagtacggcgcgcacaacatcgattggctgatggcgaaaatgcacagcctgcaatcgggcatcttcatcgcattgggcgtgctggcggcggcgctggcgtggttctggtggcgcaaacgccgacattatcagctttaccgcgcacaattgagcgaaaaacgcgccaaacgcaaggcggaaaaggcagcgaaaaaagcggcacagaagcagcagtaa

SEQ ID NO: 728 - protein, 227 aa, Neisseria gonorrhoeae
MFALLEAFFVEYGYAAVFFVLVICGFGVPIPEDLTLVTGGVISGMGYTNPHIMFAVGMLGVLAGDGVMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 729 - DNA, 441 bp, Neisseria meningitidis
atgaaaaaattattggcggccgtgatgatggcaggtttggcaggcgcggtttccgccgccggagtccacgttgaggacggctgggcgcgcaccaccgtcgaaggtatgaaaataggcggcgcgttcatgaaaatccacaacgacgaagccaaacaagactttttgctcggcggaagcagccccgttgccgaccgcgtcgaagtgcatacccacatcaacgacaacggcgtgatgcggatgcgcgaagtcgaaggcggcgtgcctttggaagcgaaatccgttaccgaactcaaacccggcagctatcatgtgatgtttatgggtttgaaaaaacaattaaaagagggcgataaaattcccgttaccctgaaatttaaaaacgccaaagcgcaaaccgtccaactggaagtcaaaatcgcgccgatgccggcaatgaaccac

SEQ ID NO: 730 - protein, 147 aa, Neisseria meningitidis
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNH

SEQ ID NO: 731 - DNA, 474 bp, Neisseria meningitidis
atgaaaaaattattggcggccgtgatgatggcaggtttggcaggcgcggtttccgccgccggagtccacgttgaggacggctgggcgcgcaccaccgtcgaaggtatgaaaataggcggcgcgttcatgaaaatccacaacgacgaagccaaacaagactttttgctcggcggaagcagccccgttgccgaccgcgtcgaagtgcatacccacatcaacgacaacggcgtgatgcggatgcgcgaagtcgaaggcggcgtgcctttggaagcgaaatccgttaccgaactcaaacccggcagctatcatgtgatgtttatgggtttgaaaaaacaattaaaagagggcgataaaattcccgttaccctgaaatttaaaaacgccaaagcgcaaaccgtccaactggaagtcaaaatcgcgccgatgccggcaatgaaccacggtcatcaccacggcgaagcgcatcagcactaa

SEQ ID NO: 732 - protein, 157 aa, Neisseria meningitidis
MKKLLAAVMMAGLAGAVSAAGVHVEDGWARTTVEGMKIGGAFMKIHNDEAKQDFLLGGSSPVADRVEVHTHINDNGVMRMREVEGGVPLEAKSVTELKPGSYHVMFMGLKKQLKEGDKIPVTLKFKNAKAQTVQLEVKIAPMPAMNHGHHHGEAHQH

SEQ ID NO: 733 - DNA, 474 bp, Neisseria meningitidis
  misc_feature (7)..(7): N= Unknown
  misc_feature (325)..(325): N= Unknown
  misc_feature (345)..(345): N= Unknown
atgaaanaactattggcagccgtgatgatggcaggtttggcaggcgcggtttccgccgccggaatccacgttgaggacggctgggcgcgcaccaccgtcgaaggtatgaaaatgggcggcgcgttcatgaaaatccacaacgacgaagccaaacaagactttttgctcggcggaagcagccctgttgccgaccgcgtcgaagtgcatacccatatcaatgataacggtgtgatgcggatgcgcgaagtcgaaggcggcgtgcctttggaggcgaaatccgttaccgaactcaaacccggcagctatcatgtcatgtttatgggtntgaaaaaacaattaaaaganggcgacaagattcccgttaccctgaaatttaaaaacgccaaagcacaaaccgtccaactggaagtcaaaaccgcgccgatgtcggcaatggaccacggtcatcaccacggcgaagcgcatcagcactaa

SEQ ID NO: 734 - protein, 157 aa, Neisseria meningitidis
  misc_feature (3)..(3): Xaa= any amino acid
  misc_feature (109)..(109): Xaa= any amino acid
  misc_feature (115)..(115): Xaa= any amino acid
MKXLLAAVMMAGLAGAVSAAGIHVEDGWARTTVEGMKMGGAFMKIHNDEAKQDFLLGGSSPVADRVEVHTHINDNGVMRMREVEGGVPLEAKSVTELKPGSYHVMFMGXKKQLKXGDKIPVTLKFKNAKAQTVQLEVKTAPMSAMDHGHHHGEAHQH

SEQ ID NO: 735 - DNA, 8 bp, Neisseria gonorrhoeae
  misc_feature (1)..(8): N = Unknown
nnnnnnnn

SEQ ID NO: 736 - protein, 86 aa, Neisseria gonorrhoeae
INDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 737 - DNA, 474 bp, Neisseria gonorrhoeae
atgaaaaaattattggcagccgtgatgatggcaggtttggcaggcgcggtttccgccgccggagtccatgtcgaggacggctgggcgcgcaccactgtcgaaggtatgaaaatgggcggcgcgttcatgaaaatccacaacgacgaagccatacaagactttgtgctcggcggaagcatgcccgttgccgaccgcgtcgaagtgcatacacacatcaacgacaacggcgtgatgcgtatgcgcgaagtcaaaggcggcgtgcctttggaggcgaaatccgttaccgaactcaaacccggcagctatcacgtgatgtttatgggtttgaaaaaacaactgaaagagggcgacaagattcccgttaccctgaaatttaaaaacgccaaagcgcaaaccgtccaactggaagtcaaaaccgcgccgatgtcggcaatgaaccacggtcatcaccacggcgaagcgcatcagcactaa

SEQ ID NO: 738 - protein, 157 aa, Neisseria gonorrhoeae
MKKLLAAVMMAGLAGAVSAAGVHVEDGWARTTVEGMKMGGAFMKIHNDEAIQDFVLGGSMPVADRVEVHTHINDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 739 - DNA, 702 bp, Neisseria meningitidis
atgacggtaactgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatacgtgctgtccgacagcagccgttcgtttaaaacgccggtactcgtgccgtttccccagcccggtatttggacgatygctttcgtgtcagggcaggtgtcgaatgcggttaaggccgcattgccgaasgacggcgattatctttccgtgtatgttccgaccacgccgaatccgaccggcggttactatattatggtaaagaaaagcgatgtgcgcgaactcgatatgagcgtggacgaascattgaaatatgtgatttcgctgggtatggtcatccctgacgacctgcccgtcaaaacattggcasgacctatgccgtctgaaaaggcggatttgcccgaacaacaataa

SEQ ID NO: 740 - protein, 233 aa, Neisseria meningitidis
  misc_feature (160)..(160): Xaa= any amino acid
  misc_feature (198)..(198): Xaa= any amino acid
  misc_feature (220)..(220): Xaa= any amino acid
MTVTAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSEYVLSDSSRSFKTPVLVPFPQPGIWTIAFVSGQVSNAVKAALPXDGDYLSVYVPTTPNPTGGYYIMVKKSDVRELDMSVDEXLKYVISLGMVIPDDLPVKTLAXPMPSEKADLPEQQ

SEQ ID NO: 741 - DNA, 702 bp, Neisseria meningitidis
  misc_feature (11)..(11): N= Unknown
atgacggaacntgcggccgaaggcggcaaagctgccaargcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatcgctgctgtccgacagcagccgttcgtttaaaacgccggtactcgtgccgtttccccagcccggtatttggacgattgctttcgtgtcagggcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcattgaaatatgtgatttcgctgggtatggtcatccctgacgacctgcccgtcaaaacattggcaggacctatgccgtctgaaaaggcggatttgcccgaacaacaataa

SEQ ID NO: 742 - protein, 233 aa, Neisseria meningitidis
  misc_feature (4)..(4): Xaa= any amino acid
MTEXAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQPGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 743 - DNA, 702 bp, Neisseria meningitidis
  misc_feature (351)..(351): N= Unknown
atgacggaacctgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattatttgccgcaaacgtattgggccggcagattcttgccgcgtgggacagcttgttggggcggattccggttgtgaagtccatctattcgagtgtgaaaaaagtatccgantcgttgctgtccgacagcagccgttcgtttaaaacaccagtactcgtgccgtttccccaatcgggtatttggacaatcgcattcgtgtccggtcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcgttgaaatatgtgatttcgctgggtatggtcatccctgacgacctgcccgtcaaaacattggcaggacctatgccgtctgaaaaggcggatttgcccgaacaacaataa

SEQ ID NO: 744 - protein, 233 aa, Neisseria meningitidis
  misc_feature (117)..(117): Xaa= any amino acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSXSLLSDSSRSFKTPVLVPFPQSGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 745 - DNA, 8 bp, Neisseria gonorrhoeae
  misc_feature (1)..(8): N = Unknown
nnnnnnnn

SEQ ID NO: 746 - protein, 233 aa, Neisseria gonorrhoeae
  misc_feature (100)..(100): Xaa= any amino acid
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLXRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 747 - DNA, 702 bp, Neisseria gonorrhoeae
atgacggaacctgcggccgaaggcggcaaagctgccaaggcgttaaaaaaatatctgattacaggcattttggtctggctgccgattgcggtaacggtttgggtggtttcctatatcgtttccgcgtccgaccagcttgtcaacctgctgccgaagcaatggcggccgcaatatgttttggggtttaatatccccgggctcggcgttattgttgccattgccgtattgtttgtaaccggattatttgccgcaaacgtgttgggccggcagattcttgccgcgtgggacagcctgttggggcggattccggttgtcaaatccatctattcgagtgtgaaaaaagtatccgaatcgctgctgtccgacagcagccgttcgtttaaaacgccggtactcgtgccgtttccccaatcgggtatttggacaatcgcattcgtgtccggtcaggtgtcgaatgcggttaaggccgcattgccgcaggatggcgattatctttccgtgtatgtcccgaccacgcccaacccgaccggcggttactatattatggtaaagaaaagcgatgtgcgcgaactcgatatgagcgtggacgaagcgttgaaatatgtgatttcgctgggtatggtcatccctgacgacctgcccgtcaaaacattggcaggacctatgccgcctgaaaaggcggagttgcccgaacaacaataa

SEQ ID NO: 748 - protein, 233 aa, Neisseria gonorrhoeae
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 749 - DNA, 1161 bp, Neisseria meningitidis
  misc_feature (235)..(235): N= Unknown
atgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggsggtactcaatatccccgaaaagatgcagcgtttcggttcggcncgtaaaggcckcaagsscgsgcttgccttgaacaaggcgggtttggcgtattttgaagggcgttttgaaaaggcggaactagaagcctcacgcgtgttggtcaacaaagtaggccgagagacaaccggactttggcattgatgctgrgcgcgcacgccgccggacagatggaaaacatcgasstgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaattcgttacgctttcgacaggggcgacgcgttgcaggttctggcaaaaaccgaaaaactttccaaggcgggcgcgttgggcaaatcggaaatggaacggtatcaaaattgggcatatccgtcgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcasaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgccttcggccgcaaactttggggcaaggcaaaaggctaccttgaagcgagcattgcattaaagccgagtatttccgcgcgtttggttctaacaaaggttttcgacgaaatcggagaaccgcagaaggcggaggcgcac

SEQ ID NO: 750 - protein, 386 aa, Neisseria meningitidis
  misc_feature (82)..(82): Xaa= any amino acid
  misc_feature (84)..(85): Xaa= any amino acid
  misc_feature (127)..(127): Xaa= any amino acid
  misc_feature (138)..(139): Xaa= any amino acid
  misc_feature (196)..(196): Xaa= any amino acid
  misc_feature (291)..(291): Xaa= any amino acid
MKTVVWIVVLFAAAVGLALASGIYTGDVYIVLGQTMLRINLHAFVLGSLIAVVVWYFLFKFIIGVLNIPEKMQRFGSARKGXKXXLALNKAGLAYFEGRFEKAELEASRVLVNKVGRDNRTLALMLXAHAAGQMENIXXRDRYLAEIAKLPEKQQLSRYLLLAESALNRRDYEAAEANLHAAAKMNANLTRLVRLXIRYAFDRGDALQVLAKTEKLSKAGALGKSEMERYQNWAYRRQLADAADAAALKTCLKRIPDSLKNGELSVSVAEKYERLGLYADAVKWVKQHYPXNRRPELLEAFVESVRFLGEREQQKAIDFADAWLKEQPDNALLLMYLGRLAFGRKLWGKAKGYLEASIALKPSISARLVLTKVFDEIGEPQKAEAH

SEQ ID NO: 751 - DNA, 1224 bp, Neisseria meningitidis
atgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctga

SEQ ID NO: 752 - protein, 407 aa, Neisseria meningitidis
MKTVVWIVVLFAAAVGLALASGIYTGDVYIVLGQTMLRINLHAFVLGSLIAVVVWYFLFKFIIGVLNIPEKMQRFGSARKGRKAALALNKAGLAYFEGRFEKAELEASRVLVNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQLADAADAAALKTCLKRIPDSLKNGELSVSVAEKYERLGLYADAVKWVKQHYPHNRRPELLEAFVESVRFLGEREQQKAIDFADAWLKEQPDNALLLMYLGRLAYGRKLWGKAKGYLEASIALKPSISARLVLAKVFDEIGEPQKAEAQRNLVLEAVSDDERHAALEQHS

SEQ ID NO: 753 - DNA, 1218 bp, Neisseria meningitidis
  misc_feature (42)..(43): N= Unknown
  misc_feature (70)..(70): N= Unknown
  misc_feature (203)..(203): N= Unknown
  misc_feature (646)..(646): N= Unknown
  misc_feature (665)..(665): N= Unknown
  misc_feature (718)..(718): N= Unknown
  misc_feature (900)..(900): N= Unknown
  misc_feature (1004)..(1004): N= Unknown
  misc_feature (1197)..(1197): N= Unknown
atgaaaacggtagtctggattgtcgtcctgtttgccgccgcnntcgggctggcattggcgtcgggcattnacaccggcgacgtgtatatcgtactcggacagaccatgctcagaatcaacctgcacgcctttgtgttaggttcgctgattgccgtcgtggtgtggtatttcctgttcaaattcatcatcggcgtactcaatanccccgaaaagatgcagcgtttcggttcggcgcgtaaaggccgcaaggccgcgcttgctttgaacaaggcgggtttggcgtattttgaagggcgttttgaaaaggcggaacttgaagcctcgcgcgtattgggaaacaaagaggcgggggataaccggactttggcattgatgttgggcgcacatgccgccgggcagatggaaaacatcgagctgcgcgaccgttatcttgcggaaatcgccaaactgccggaaaagcagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaantttccaaggcgggcgcgtngggcaaatcggaaatggaacggtatcaaaattgggcataccgccgccagctgncggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgacccgaacttttggaagcntttgtcgaaagcgtgcgctttttgggcgaacgcgatcagcagaaagccatcgattttgccgatgcttggctgaaagaacagcccgataatgcgcttctgctgangtatctcggtcggctcgcctacggccgcaaactttggggcaaggcaaaaggctaccttgaagcgagcattgcattaaagccgagtatttccgcgcgtttggttctggcaaaggtttttgacgaaaccggagaaccgcagaaggcggaggcgcagcgcaacttggttttggcaagcgttgccgaggaaaaccgnccttccgccgaaacccattga

SEQ ID NO: 754 - protein, 405 aa, Neisseria meningitidis
  misc_feature (15)..(15): Xaa= any amino acid
  misc_feature (24)..(24): Xaa= any amino acid
  misc_feature (68)..(68): Xaa= any amino acid
  misc_feature (216)..(216): Xaa= any amino acid
  misc_feature (222)..(222): Xaa= any amino acid
  misc_feature (240)..(240): Xaa= any amino acid
  misc_feature (335)..(335): Xaa= any amino acid
MKTVVWIVVLFAAAXGLALASGIXTGDVYIVLGQTMLRINLHAFVLGSLIAVVVWYFLFKFIIGVLNXPEKMQRFGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKXSKAGAXGKSEMERYQNWAYRRQLXDAADAAALKTCLKRIPDSLKNGELSVSVAEKYERLGLYADAVKWVKQHYPHNRRPELLEAFVESVRFLGERDQQKAIDFADAWLKEQPDNALLLXYLGRLAYGRKLWGKAKGYLEASIALKPSISARLVLAKVFDETGEPQKAEAQRNLVLASVAEENRPSAETH

SEQ ID NO: 755 - DNA, 1218 bp, Neisseria gonorrhoeae
atgaaaacggtagtctggattgttgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcctgtttaaattcatcatcggcgtactcaatatccccgaaaatatgcggcgttccggttcggcgcggaaaggccgcaaggccgcgcttgccttgaataaggcgggtttggcgtatttcgaagggcgttttgaaaaggcggaactcgaagcctctcgagtgttgggcaacaaagaggccggagacaaccggactttggcattgatgctgggcgcgcacgcggcaggacagatggaaaatatcgagctgcgcgaccgttatcttgcggaaatcgccaaactgccggaaaaacagcagctttcccgctatcttctgctggcggaatcggcgttaaaccggcgcgattacgaagcggcggaagccaatcttcatgcggcggcgaagatgaatgccaaccttacgcgcctcgtgcgtctgcaacttcgttacgccttcgatcggggcgatgcgttgcaggttctggcaaaaaccgaaaaactttccaaggcgggcgcgttgggcaaatcggaaatggaacggtatcaaaattgggcataccgccgccagatggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgattcttggctgaaagaacagcccgataacgcgcttctgctgatgtatctcggccggctcgcctacggccgcaaactttggggtaaggcaaaaggctaccttgaagcgagtattgcactgaagccgagtattccggcgcgtttggtgttggcaaaggtttttgacgaaaccgcacagtcgcaaaaagccgaagcacagcgcaacttggttttggcaagcgttgccggggaaaaccgcccttccgccgaaacccgttga

SEQ ID NO: 756 - protein, 405 aa, Neisseria gonorrhoeae
MKTVVWIVVLFAAAVGLALASGIYTGDVYIVLGQTMLRINLHAFVLGSLIAVVVWYFLFKFIIGVLNIPENMRRSGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQMADAADAAALKTCLKRIPDSLKNGELSVSVAEKYERLGLYADAVKWVKQHYPHNRRPELLEAFVESVRFLGEREQQKAIDFADSWLKEQPDNALLLMYLGRLAYGRKLWGKAKGYLEASIALKPSIPARLVLAKVFDETAQSQKAEAQRNLVLASVAGENRPSAETR

SEQ ID NO: 757 - DNA, 429 bp, Neisseria meningitidis
atgatgttttcttggttcaagctgtttcacttgttttttgtcatttcgtggtttgcagggctgttttacctgccgaggattttcgtcaatatggcgatgattgatgtgccgcgcggcaatcccgagtatgtgcgtctgtcgggcatggcggtgcggctgtaccgttttatgtcgccgttgggcttcggcgcggtcgtgttcggcgcggcgataccgtttgccgccggctggtggggcagcggctgggtacacgtcaaactgtgtttgggcttgatgctcttggcttaccagttgtattgcggcgtgctgctgcgccgttttcaggattacagcaatgctttttcacaccgctggtaccgcgtgttcaacgaaatccccgtgctgctgatggttgccgcgctgtatstggtcgtgttcaaaccgttttga

SEQ ID NO: 758 - protein, 142 aa, Neisseria meningitidis
  misc_feature (136)..(136): Xaa= any amino acid
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYXVVFKPF

SEQ ID NO: 759 - DNA, 429 bp, Neisseria meningitidis
atgatgttttcttggttcaagctgtttcacttgttttttgtcatttcgtggtttgcagggctgttttacctgccgaggattttcgtcaatatggcgatgattgatgtgccgcgcggcaatcccgagtatgtgcgtctgtcgggcatggcggtgcggctgtaccgttttatgtcgccgttgggcttcggcgcggtcgtgttcggcgcggcgataccgtttgccgccggctggtggggcagcggctgggtacacgtcaaactgtgtttgggcttgatgctcttggcttaccagttgtattgcggcgtgctgctgcgccgttttcaggattacagcaatgctttttcacaccgctggtaccgcgtgttcaacgaaatccccgtgctgctgatggttgccgcgctgtatctggtcgtgttcaaaccgttttga

SEQ ID NO: 760 - protein, 142 aa, Neisseria meningitidis
MMFSWFKLFHLFFVISWFAGLFYLPRIFVNMAMIDVPRGNPEYVRLSGMAVRLYRFMSPLGFGAVVFGAAIPFAAGWWGSGWVHVKLCLGLMLLAYQLYCGVLLRRFQDYSNAFSHRWYRVFNEIPVLLMVAALYLVVFKPF

SEQ ID NO: 761 - DNA, 429 bp, Neisseria meningitidis; identical to SEQ ID NO: 759

SEQ ID NO: 762 - protein, 142 aa, Neisseria meningitidis; identical to SEQ ID NO: 760

SEQ ID NO: 763 - DNA, 429 bp, Neisseria gonorrhoeae
atgatgttttcttggttcaagctgtttcacttgttttttgtcatttcgtggtttgcagggctgttttacctgccgaggattttcgtcaatatggcgatgattgatgcgccgcgcggcaatcccgagtatgtgcgcctgtcggggatggcggtgcggttgtaccgttttatgtcgcctttgggtttcggcgcggtcgtgttcggcgcggcgataccgtttgccgccggccggtggggcagcggctgggttcacgtcaaactgtgtttgggcttgatgctcttggcttatcagttgtattgcggcgtgctgctgcgccgttttcaggattacagcaatgctttttcacaccgctggtaccgcgtgttcaacgaaatccccgtgctgctgatggttgccgcgctgtatctggtcgtgttcaaaccgttttga

SEQ ID NO: 764 - protein, 142 aa, Neisseria gonorrhoeae
MMFSWFKLFHLFFVISWFAGLFYLPRIFVNMAMIDAPRGNPEYVRLSGMAVRLYRFMSPLGFGAVVFGAAIPFAAGRWGSGWVHVKLCLGLMLLAYQLYCGVLLRRFQDYSNAFSHRWYRVFNEIPVLLMVAALYLVVFKPF

SEQ ID NO: 765 - DNA, 592 bp, Artificial Sequence
  Novel Sequence
  misc_feature (24)..(30): N= Unknown
atggcaaaaatgatgaaatgggcnnnnnnnggctgttgcggcggtcgcggcggcagcggtttggggcggatggtcttaactgaagcccgagccgcacgtgcttgatattacggaaacggtcaggcgcggcatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 766 - protein, 392 aa, Neisseria meningitidis
  misc_feature (24)..(24): Xaa= any amino acid
  misc_feature (42)..(239): Xaa= any amino acid
MAKMMKWAAVAAVAAAAVWGGWSXLKPEPHVLDITETVRRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 767 - DNA, 1005 bp, Neisseria meningitidis
gtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 768 - protein, 334 aa, Neisseria meningitidis
VSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 769 - DNA, 1179 bp, Neisseria meningitidis
atggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagaaactttatgtcaaactcgggcaacaggttaaaaagggcgatttgattgcggaaatcaattcgacctcgcagaccaatacgctcaatacggaaaaatccaaattggaaacgtatcaggcgaagctggtgtcggcacagattgcattgggcagcgcggagaagaaatataagcgtcaggcggcgttgtggaaggatgatgcgaccgctaaagaagatttggaaagcgcacaggatgcgcttgccgccgccaaagccaatgttgccgagctgaaggctctaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctactattatgcccgttcgtttgtgccgaatccggacggcaaactcgccacggggatgacgacgcagaatacggttgaaatcgacggtgtgaaaaatgtgctgattattccgtcgctgaccgtgaaaaatcgcggcggcagggcgtttgtgcgcgtgttgggtgcagacggcaaggcggcggaacgcgaaatccggaccggtatgagagacagtatgaataccgaagtaaaaagcgggttgaaagagggggacaaagtggtcatctccgaaataaccgccgccgagcagcaggaaagcggcgaacgcgccctaggcggcccgccgcgccgataa

SEQ ID NO: 770 - protein, 392 aa, Neisseria meningitidis
MAKMMKWAAVAAVAAAAVWGGWSYLKPEPQAAYITETVRRGDISRTVSATGEISPSNLVSVGAQASGQIKKLYVKLGQQVKKGDLIAEINSTSQTNTLNTEKSKLETYQAKLVSAQIALGSAEKKYKRQAALWKDDATAKEDLESAQDALAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGRAFVRVLGADGKAAEREIRTGMRDSMNTEVKSGLKEGDKVVISEITAAEQQESGERALGGPPRR

SEQ ID NO: 771 - DNA, 1179 bp, Neisseria gonorrhoeae
atggcaaaaatgatgaaatgggcggctgttgcggcggtcgcggcggcaacggtttggggcggatggtcttatctgaagcccgaaccgcaggctgcttatattacggaaacggtcaggcgcggcgatatcagccggacggtttccgcgacgggcgagatttcgccgtccaacctggtatcggtcggcgcgcaggcttcggggcagattaaaaagctttatgtcaaactcgggcaacaggtcaaaaagggcgatttgattgcggaaatcaattcgaccacgcagaccaacacgatcgatatggaaaaatccaaattggaaacgtatcaggcgaagctggtgtcggcacagattgcattgggcagcgcggagaagaaatataagcgtcaggcggcgttgtggaaggatgatgcgacctctaaagaagatttggaaagcgcgcaggatgcgcttgccgccgccaaagccaatgttgccgagttgaaggctttaatcagacagagcaaaatttccatcaataccgccgagtcggatttgggctacacgcgcattaccgcgacgatggacggcacggtggtggcgattcccgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctattattatgcccgttcgtttgtgccgaatccggacggcaaactcgccacggggatgacgacgcagaatacggttgaaatcgacggtgtgaaaaatgtgttgcttattccgtcgctgaccgtgaaaaatcgcggcggcaaggcgttcgtacgcgtgttgggtgcggacggcaaggcagtggaacgcgaaatccggaccggtatgaaagacagtatgaataccgaagtgaaaagcgggttgaaagagggggacaaagtggtcatctccgaaataaccgccgccgagcagcaggaaagcggcgaacgcgccctaggcggcccgccgcgccgataa

SEQ ID NO: 772 - protein, 392 aa, Neisseria gonorrhoeae
MAKMMKWAAVAAVAAAAVWGGWSYLKPEPQAAYITEAVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 773 - DNA, 555 bp, Neisseria meningitidis
attcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 774 - protein, 184 aa, Neisseria meningitidis
IPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 775 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 776 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 777 - DNA, 672 bp, Neisseria meningitidis
  misc_feature (82)..(82): N= Unknown
  misc_feature (129)..(129): N= Unknown
  misc_feature (131)..(132): N= Unknown
  misc_feature (134)..(135): N= Unknown
  misc_feature (137)..(138): N= Unknown
  misc_feature (140)..(140): N= Unknown
  misc_feature (143)..(145): N= Unknown
  misc_feature (147)..(147): N= Unknown
  misc_feature (149)..(149): N= Unknown
  misc_feature (158)..(158): N= Unknown
  misc_feature (326)..(330): N= Unknown
  misc_feature (332)..(332): N= Unknown
  misc_feature (334)..(339): N= Unknown
  misc_feature (341)..(341): N= Unknown
  misc_feature (378)..(378): N= Unknown
atgatgaagacttttaaaaatatattttccgccgccattttgtccgccgccctgccgtgcgcgtatgcggcagggctgcccnaatccgccgtgctgcactattccggcagctacggcattcccgccacnannanntnngnacnnngngncaatgcttncaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcggnnnnnancnnnnnngngcaaagccccaaggctatggatttgttcacgcttgcntggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 778 - protein, 223 aa, Neisseria meningitidis
  misc_feature (28)..(28): Xaa= any amino acid
  misc_feature (44)..(50): Xaa= any amino acid
  misc_feature (53)..(53): Xaa= any amino acid
  misc_feature (109)..(114): Xaa= any amino acid
MMKTFKNIFSAAILSAALPCAYAAGLPXSAVLHYSGSYGIPATXXXXXXXNAXKIVSTIKVPLYNIRFESGGTVVGNTLHPTYYRDIRRGKLYAEAKFADGSVTYGKAXXXXXXQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 779 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 780 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 781 - DNA, 468 bp, Neisseria meningitidis
  misc_feature (51)..(51): N= Unknown
atgtatcggaggaaagggcggggcatcaagccgtggatgggtgccggtgcngcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatatt

SEQ ID NO: 782 - protein, 156 aa, Neisseria meningitidis
  misc_feature (17)..(17): Xaa= any amino acid
MYRRKGRGIKPWMGAGXAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNI

SEQ ID NO: 783 - DNA, 1071 bp, Neisseria meningitidis
atgtatcggaggaaagggcggggcatcaagccgtggatgggtgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtaatgctgattatgggcttggtttacggtttgggattggtgctggtcgggctggattcggggtttgccatcggtatgcttgccggtattttggtgtttgtcccttatctcggggcgtttacgggattgctgcttgccaccgtcgccgccttgctccagttcggttcgtggaacggcatcctatcggtttgggcggtttttgccgtaggacagtttctcgaaagttttttcattacgccgaaaatcgtgggagaccgtatcgggctgtcgccgttttgggttatcttttcgctgatggcgttcgggcagctgatgggctttgtcggaatgttggcgggattgcctttggccgccgtaaccttggtcttgcttcgcgagggcgtgcagaaatattttgccggcagtttttaccggggcaggtag

SEQ ID NO: 784 - protein, 356 aa, Neisseria meningitidis
MYRRKGRGIKPWMGAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMLAGILVFVPYLGAFTGLLLATVAALLQFGSWNGILSVWAVFAVGQFLESFFITPKIVGDRIGLSPFWVIFSLMAFGQLMGFVGMLAGLPLAAVTLVLLREGVQKYFAGSFYRGR

SEQ ID NO: 785 - DNA, 1071 bp, Neisseria meningitidis
atgtatcggaggaaagggcggggcatcaagccgtggatggatgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattattgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggcgagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtgatgctgattatgggtttggtttacggcttggggttggtgctggtcgggctggattcggggtttgcaatcggtatggttgccggtattttggtttttgttccctatttgggcgcgtttacaggactgctgctggcaaccgtcgccgccttgctccagttcggttcgtggaacggcatcttggctgtttgggcggtttttgccgtaggacagtttctcgaaagttttttcattacgccgaaaatcgtgggagaccgtatcggcctgtcgccgttttgggttatcttttcgctgatggcgttcgggcagctgatgggctttgtcggaatgttggccggattgcctttggccgccgtaaccttggtcttgcttcgcgagggcgtgcagaaatattttgccggcagtttttaccggggcaggtag

SEQ ID NO: 786 - protein, 356 aa, Neisseria meningitidis
MYRRKGRGIKPWMDAGAAFAALVWLVFALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWLQAHTGELSNALKAWFPVLMRQGGNIVSSIGNLLLLPLLLYYFLLDWQRWSCGIAKLVPRRFAGAYTRITGNLNEVLGEFLRGQLLVMLIMGLVYGLGLVLVGLDSGFAIGMVAGILVFVPYLGAFTGLLLATVAALLQFGSWNGILAVWAVFAVGQFLESFFITPKIVGDRIGLSPFWVIFSLMAFGQLMGFVGMLAGLPLAAVTLVLLREGVQKYFAGSFYRGR

SEQ ID NO: 787 - DNA, 8 bp, Neisseria gonorrhoeae
  misc_feature (1)..(8): N = Unknown
nnnnnnnn

SEQ ID NO: 788 - protein, 253 aa, Neisseria gonorrhoeae
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSTIGNLLLPPLLLYYFLLDWHRWSCGIPKLVPRRFAGAYTRITGNLNKVWGKFLRGQLLGETERGAVVCRVGRECWEGGGARSRPSDDGWPRWGGG

SEQ ID NO: 789 - DNA, 1071 bp, Neisseria gonorrhoeae
atgtatcggagaaaaggacggggcatcaagccgtggatgggtgccggcgcggcgtttgccgccttggtctggctggtttacgcgctcggcgatactttgactccgtttgcggttgcggcggtgctggcgtatgtgttggaccctttggtcgaatggttgcagaaaaagggtttgaaccgtgcatccgcttcgatgtctgtgatggtgttttccttgattttgttgttggcattattgttgattattgtccctatgctggtcgggcagttcaataatttggcatctcgcctgccccaattaatcggttttatgcagaacacgctgctgccgtggttgaaaaatacaatcggcggatatgtggaaatcgatcaggcatctattattgcgtggtttcaggcgcatacgggcgagttgagcaacgcgcttaaggcgtggtttcccgttttgatgaaacagggcggcaatattgtcagcagtatcggcaacctgctgctgccgcccttgctgctttactatttcctgctggattggcagcggtggtcgtgcggcatcgccaaactggttccgaggcgttttgccggtgcttatacgcgcattacgggtaatttgaacgaggtattgggcgaatttttgcgcggtcagcttctggtgatgctgattatgggcttggtttacggtttgggattgatgctagtcggactggattcgggatttgccatcggtatggttgccggtattttggtgtttgtcccctatttgggtgcgtttacgggattgctgcttgccactgttgcagccttgctccagttcggttcgtggaacggaatcttggctgtttgggcggtttttgccgtcggtcagtttctcgaaagttttttcattacgccgaaaattgtaggagaccgtatcggcctgtcgccgttttgggttatcttttcgctgatggcgttcggagagctgatgggctttgtcggaatgttggccggattgcctttggccgccgtaaccttggtcttgcttcgcgagggcgcgcagaaatattttgccggcagtttttaccggggcaggtag

SEQ ID NO: 790 - protein, 356 aa, Neisseria gonorrhoeae
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSSIGNLLLPPLLLYYFLLDWQRWSCGIAKLVPRRFAGAYTRITGNLNEVLGEFLRGQLLVMLIMGLVYGLGLMLVGLDSGFAIGMVAGILVFVPYLGAFTGLLLATVAALLQFGSWNGILAVWAVFAVGQFLESFFITPKIVGDRIGLSPFWVIFSLMAFGELMGFVGMLAGLPLAAVTLVLLREGAQKYFAGSFYRGR

SEQ ID NO: 791 - DNA, 546 bp, Neisseria meningitidis
actgctttttcggcggcgctgcgcttgagtccatcatgactcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtgtgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcag

SEQ ID NO: 792 - protein, 182 aa, Neisseria meningitidis
  misc_feature (13)..(13): Xaa= any amino acid
TAFSAALRLSPSXLVIFLSFGKPYQQTAAILTFFCTSCPPRSNAYQQYRRLRLYAFHPPEIAEFFVGFAFDVDARNVYAQIGGDVGTHLRNVRRECGFLCNHGRIDIDRLPTLRLNALIRRTQKDAAVRIFELCGGVGEMAADIAQTCRTEQRVGNGVQQRIGIGVSEQPFFKWDFNSAKYQ

SEQ ID NO: 793 - DNA, 771 bp, Neisseria meningitidis
atatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctga

SEQ ID NO: 794 - protein, 256 aa, Neisseria meningitidis
ISYWASSSPDFLEVDTAPLIFLPLLPKASMKKLMVEPVPMPIYSFSGTNSTAFSAAMRLSSSCVVIFLSFGKPYQQTAAILTFFCTSCPPRSNAYQQYRRLRLYAFHPPEIAEFFVGFAFDVDARNVYAQIGGDVGTHLRNVRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 795 - DNA, 771 bp, Neisseria meningitidis
  misc_feature (156)..(156): N= Unknown
  misc_feature (253)..(255): N= Unknown
  misc_feature (363)..(363): N= Unknown
atatcatattgggcaagcagttcactggattttttggaagtagataccgcgcctttgatttttttgccgctcttacccaaggcttcgatgaaaaagttgatggtcgaaccggtaccgatgccgatgtattcgttttcgggtacgaattcgactgcnttttcggcggcgatgcgcttgagttcgtcttgtgtcgtcatatttttgtcctttgggaaaccgtatcaacaaacagccgccatcttaacattttttnnnacgtcctgcccgccgcgttcaaatccttaccagcaataccgccgcctgcgactctatgccttccatgcgcccgagataaccgagtttttcgttggttttgcctttgangttgacgcacgaaatgtctatgcccaaatcggcggcgatgttggcacgcatttgcggaatatgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctga

SEQ ID NO: 796 - protein, 256 aa, Neisseria meningitidis
  misc_feature (85)..(85): Xaa= any amino acid
  misc_feature (121)..(121): Xaa= any amino acid
ISYWASSSLDFLEVDTAPLIFLPLLPKASMKKLMVEPVPMPMYSFSGTNSTAFSAAMRLSSSCVVIFLSFGKPYQQTAAILTFFXTSCPPRSNPYQQYRRLRLYAFHAPEITEFFVGFAFXVDARNVYAQIGGDVGTHLRNMRREFGFLCNHGRIDIDRLPTLRLNALIRRTQKDAAVRIFELCGGVGEMAADIAQTCRTEQRVGNGVQQRIGIGVSEQPFFKWDFNSAKYQLSAFGQLVDIVALSDTDVRHRLCS

SEQ ID NO: 797 - DNA, 771 bp, Neisseria gonorrhoeae
atgtcgtaccgggcaagcagttcgccggattttttggaggttgaaaccgcgcctttgatttttttaccgcttttgcccaaggcttcgatgaagaaattgatggtcgaaccggtaccgatgccgatgtattcgttttcgggtacgaattcgactgctttttcggcggcgatgcgcttgagttcgtcttgcgtcgtcatatttttatcctttgggaaaccctatcaacaaacagccgccatcttaacatttttttgcacgtcctggccgccgcgttcaaatccgtaccagcaataccgccgcctgcgcctctatgccttccatccgcccgagatagccgagtttttcgttggttttgcctttgatattgacgcacgaaatatcgatacccaaatcggcggcgatgttggcacgcatttgcggaatgtgcggtgcgagtttgggtttctgtgcaatcacggtcgtatcgacattgaccacctgccaaccctgcgcctgaacgctttgatacgccgcacgcaaaaggacgcggctgtccgcatctttgaactctgcggcggtgtcgggaaaatggctgccgatgtcgcccaaacctgccgcaccgagcagcgcgtcggtaacggcgtgcagcagcgcgtcggcatccgaatgcccgagcagccctttttcaaatgggatttcaactccgccaagtatcagctttctgccttcggtcaattggtggacatcgtagccctgtccgatacggatattcgtcatcgtttgtgttcctga

SEQ ID NO: 798 - protein, 256 aa, Neisseria gonorrhoeae
MSYRASSSPDFLEVETAPLIFLPLLPKASMKKLMVEPVPMPMYSFSGTNSTAFSAAMRLSSSCVVIFLSFGKPYQQTAAILTFFCTSWPPRSNPYQQYRRLRLYAFHPPEIAEFFVGFAFDIDARNIDTQIGGDVGTHLRNVRCEFGFLCNHGRIDIDHLPTLRLNALIRRTQKDAAVRIFELCGGVGKMAADVAQTCRTEQRVGNGVQQRVGIRMPEQPFFKWDFNSAKYQLSAFGQLVDIVALSDTDIRHRLCS

SEQ ID NO: 799 - DNA, 197 bp, Neisseria meningitidis
gccggcgcgagtgcgaacaacatttccgcgcgttttgcggaaacacccgtcgctgtcagcgttaccctgatcggcacggtacttgccgtcatgctgcccgttaccgaatatgaaaacttcctgctgcttatcggctcggtatttgcgccgatggggcggattttgattgccgactttttcgtcttgaaacggcgtga

SEQ ID NO: 800 - protein, 64 aa, Neisseria meningitidis
AGASANNISARFAETPVAVSVTLIGTVLAVMLPVTEYENFLLLIGSVFAPMGGFDCRLFRLETA

SEQ ID NO: 801 - DNA, 1224 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctctccaccgttaccacaacgtttctcgatgcctattccgccggcgcgagtgcgaacaacatttccgcgcgttttgcggaaacacccgtcgctgtcggcgttaccctgatcggcacggtacttgccgtcatgctgcccgttaccgaatatgaaaacttcctgctgcttatcggctcggtatttgcgccgatggcggcggttttgattgccgactttttcgtcttgaaacggcgtgaggagattgaaggctttgactttgccggactggttctgtggcttgcgggcttcatcctctaccgcttcctgctctcgtccggctgggaaagcagcatcggtctgaccgcccccgtaatgtctgccgttgccattgccaccgtatcggtacgccttttctttaaaaaaacccaatctttacaaaggaacccgtcatga

SEQ ID NO: 802 - protein, 407 aa, Neisseria meningitidis
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGASANNISARFAETPVAVGVTLIGTVLAVMLPVTEYENFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 803 - DNA, 1041 bp, Neisseria meningitidis
  misc_feature (23)..(23): N= Unknown
  misc_feature (132)..(132): N= Unknown
  misc_feature (206)..(206): N= Unknown
  misc_feature (209)..(209): N= Unknown
  misc_feature (499)..(499): N= Unknown
  misc_feature (501)..(501): N= Unknown
  misc_feature (529)..(530): N= Unknown
  misc_feature (534)..(535): N= Unknown
  misc_feature (579)..(579): N= Unknown
  misc_feature (825)..(825): N= Unknown
  misc_feature (879)..(879): N= Unknown
atgtcgggcaatgcctcctctcnttcatcttccgccgccatcgggctgatttggttcggcgcggcggtatcgattgccgaaatcagcacgggtacactgcttgcgcctttgggctggcagcgcggtctggcngctctgcttttgggtcatgccgtcggcggcgcgctgttttttgcggcggcgtatatcggcgcactgaccggacncanctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaantnttttccacggcaggcagcaccgccgcannggtnncagacggcatgagtttcggaacggcagtcgagctgtccgccgtnatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcntactccgccggcgtaagtgccaacaatatttccgccaaactttcggaaataccnatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtgaggagattgaaggc

SEQ ID NO: 804 - protein, 347 aa, Neisseria meningitidis
  misc_feature (8)..(8): Xaa= any amino acid
  misc_feature (69)..(70): Xaa= any amino acid
  misc_feature (167)..(167): Xaa= any amino acid
  misc_feature (177)..(177): Xaa= any amino acid
  misc_feature (179)..(179): Xaa= any amino acid
MSGNASSXSSSAAIGLIWFGAAVSIAEISTGTLLAPLGWQRGLAALLLGHAVGGALFFAAAYIGALTGXXSMESVRLSFGKRGSVLFSVANMLQLAGWTAVMIYAGATVSSALGKVLWDGESFVWWALANGALIVLWLVFGARKTGGLKTVSMLLMLLAVLWLSAEXFSTAGSTAAXVXDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAAVLIADFFVLKRREEIEG

SEQ ID NO: 805 - DNA, 8 bp, Neisseria gonorrhoeae
  misc_feature (1)..(8): N = Unknown
nnnnnnnn

SEQ ID NO: 806 - protein, 343 aa, Neisseria gonorrhoeae
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIRTVLAVMLPVTEYKNFLLLIRSVFGPMAGGFDCRLFCLKTA

SEQ ID NO: 807 - DNA, 1227 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatcggcacggtgcttgccgtcatgctgcccgttaccgaatataaaaacttcctgctgcttatcggctcggtatttgcgccgatggcggcggttttgattgccgactttttcgtcttaaaacggcgtgaggagattgaaggctttgactttgccggactggttctgtggctggcaggcttcatcctctaccgcttcctgctctcgtccggttgggaaagcagcatcggtctgaccgcccccgtaatgtctgccgttgccattgccaccgtatcggtacgccttttctttaaaaaaacccaatctttacaaaggaacccgtcatga

SEQ ID NO: 808 - protein, 408 aa, Neisseria gonorrhoeae
MSGNASSPSSSAAIGLVWFGAAVSIAEISTGTLLAPLGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIGTVLAVMLPVTEYKNFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 809 - DNA, 549 bp, Neisseria meningitidis
  misc_feature (162)..(162): N= Unknown
  misc_feature (345)..(345): N= Unknown
  misc_feature (447)..(447): N= Unknown
atgacccgtatcgccatcctcggcggcggcctctcgggaaggctgaccgcgttgcagcttgcagaacaaggttatcagattgcacttttcgataaaagctgccgccggggcgaacacgccgccgcctatgtagccgccgccatgctcgcgcctgcagcgganacggtcgaagccacgcccgaagtggtcaggctgggcaggcagagcatcccgctttggcgcggcatccgatgccgtctgaacacgcacacgatgatgcaggaaaacggcagcctgattgtatggcacgggcaggacaagccattatccagcgagttcgtccgccatctcaaacgcggcggcgtnacggatgacgaaatcgtccgttggcgcgccgacgacatcgccgaacgcgaaccgcaactcggcggacgtttttaagacggcatctacctgccgaccgaagcncagctcgacgggcggcaattatagtctgcacttgccgacgctttggacgaactgaacgtcccctgccattgggaacacgaatgcgtccccgaagcctgcaag

SEQ ID NO: 810 - protein, 183 aa, Neisseria meningitidis
  misc_feature (54)..(54): Xaa= any amino acid
  misc_feature (115)..(115): Xaa= any amino acid
  misc_feature (140)..(140): Xaa= any amino acid
  misc_feature (149)..(149): Xaa= any amino acid
  misc_feature (157)..(157): Xaa= any amino acid
MTRIAILGGGLSGRLTALQLAEQGYQIALFDKSCRRGEHAAAYVAAAMLAPAAXTVEATPEVVRLGRQSIPLWRGIRCRLNTHTMMQENGSLIVWHGQDKPLSSEFVRHLKRGGXTDDEIVRWRADDIAEREPQLGGRFXDGIYLPTEXQLDGRQLXSALADALDELNVPCHWEHECVPEACK

SEQ ID NO: 811 - DNA, 1101 bp, Neisseria meningitidis
atgacccgtatcgccatcctcggcggcggcctctcgggaaggctgaccgcgttgcagcttgcagaacaaggttatcagattgcacttttcgataaaggctgccgccggggcgaacacgccgccgcctatgttgccgccgccatgctcgcgcctgcggcggaagcggtcgaagccacgcccgaagtggtcaggctgggcaggcagagcatcccgctttggcgcggcatccgatgccgtctgaacacgcacacgatgatgcaggaaaacggcagcctgattgtgtggcacgggcaggacaagccattatccagcgagttcgtccgccatctcaaacgcggcggcgtagcggatgacgaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgcgtccccgaaggcctgcaagcccaatacgactggctgatcgactgccgcggctacggcgcaaaaaccgcgtggaaccaatcccccgagcacaccagcaccctgcgcggcatacgcggcgaagtggcgcgggtttacacacccgaaatcacgctcaaccgccccgtgcgtctgctccatccgcgttatccgctctacatcgccccgaaagaaaaccacgtcttcgtcatcggcgcgacccaaatcgaaagcgaaagccaagcccccgccagcgtgcgttcagggttggaactcttgtccgcactctatgccatccaccccgccttcggcgaagccgacatcctcgaaatcgccaccggcctgcgccccacgctcaaccaccacaaccccgaaatccgttacaaccgcgcccgacgcctgattgaaatcaacggccttttccgccacggtttcatgatctcccccgccgtaaccgccgccgccgccagattggcagtggcactgtttgacggaaaagacgcgcccgaacgcgataaagaaagcggtttggcgtatatccgaagacaagattaa

SEQ ID NO: 812 - protein, 366 aa, Neisseria meningitidis
MTRIAILGGGLSGRLTALQLAEQGYQIALFDKGCRRGEHAAAYVAAAMLAPAAEAVEATPEVVRLGRQSIPLWRGIRCRLNTHTMMQENGSLIVWHGQDKPLSSEFVRHLKRGGVADDEIVRWRADDIAEREPQLGGRFSDGIYLPTEGQLDGRQILSALADALDELNVPCHWEHECVPEGLQAQYDWLIDCRGYGAKTAWNQSPEHTSTLRGIRGEVARVYTPEITLNRPVRLLHPRYPLYIAPKENHVFVIGATQIESESQAPASVRSGLELLSALYAIHPAFGEADILEIATGLRPTLNHHNPEIRYNRARRLIEINGLFRHGFMISPAVTAAAARLAVALFDGKDAPERDKESGLAYIRRQD

SEQ ID NO: 813 - DNA, 1101 bp, Neisseria meningitidis
  misc_feature (36)..(36): N= Unknown
  misc_feature (206)..(206): N= Unknown
  misc_feature (261)..(261): N= Unknown
  misc_feature (355)..(355): N= Unknown
  misc_feature (618)..(619): N= Unknown
  misc_feature (621)..(621): N= Unknown
  misc_feature (723)..(723): N= Unknown
  misc_feature (746)..(746): N= Unknown
  misc_feature (1047)..(1047): N= Unknown
atgacccgtatcgccatcctcggcggcggcctctcnggaaggctgaccgcactgcagcttgcagaacaaggttatcagattgcacttttcgataaaggctgccgccggggcgaacacgccgccgcctatgttgccgccgccatgctcgcgcctgcggcggaagcggtcgaagccacgcctgaagtggtcaggctgggcaggcagancatcccgctttggcgcggcatccgatgccatctgaaaacgcctgccatgatgcangaaaacggcagcctgattgtgtggcacgggcaggacaaacctttatccaacgagttcgtccgccatctcaaacgcggcggcgtagcggatgacnaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgtgcccccgaagacttgcaagcccaatacgactggctgatcgactgccgcggctacggcgcaaaaaccgcgtggaaccaatcccccgannanaccagcaccctgcgcggcatacgcggcgaagtggcgcgggtttacacacccgaaatcacgctcaaccgccccgtgcgcctgctacacccgcgctatccgctntacatcgccccgaaagaaaaccncgtcttcgtcatcggcgcgacccaaatcgaaagcgaaagccaagcacctgccagcgtgcgttccgggctggaactcttatccgcactctatgccgtccaccccgccttcggcgaagccgacatcctcgaaatcgccaccggcctgcgccccacgctcaatcaccacaaccccgaaatccgttacaaccgcgcccgacgcctgattgaaatcaacggccttttccgccacggtttcatgatctcccccgccgtaaccgccgccgccgtcagattggcagtggcactgtttgacggaaaagangcgcccgaacgcgatgaagaaagcggtttggcgtatatccgaagacaagattaa

SEQ ID NO: 814 - protein, 366 aa, Neisseria meningitidis
  misc_feature (69)..(69): Xaa= any amino acid
  misc_feature (87)..(87): Xaa= any amino acid
  misc_feature (119)..(119): Xaa= any amino acid
  misc_feature (206)..(207): Xaa= any amino acid
  misc_feature (249)..(249): Xaa= any amino acid
  misc_feature (349)..(349): Xaa= any amino acid
MTRIAILGGGLSGRLTALQLAEQGYQIALFDKGCRRGEHAAAYVAAAMLAPAAEAVEATPEVVRLGRQXIPLWRGIRCHLKTPAMMXENGSLIVWHGQDKPLSNEFVRHLKRGGVADDXIVRWRADDIAEREPQLGGRFSDGIYLPTEGQLDGRQILSALADALDELNVPCHWEHECAPEDLQAQYDWLIDCRGYGAKTAWNQSPXXTSTLRGIRGEVARVYTPEITLNRPVRLLHPRYPLYIAPKENXVFVIGATQIESESQAPASVRSGLELLSALYAVHPAFGEADILEIATGLRPTLNHHNPEIRYNRARRLIEINGLFRHGFMISPAVTAAAVRLAVALFDGKXAPERDEESGLAYIRRQD

SEQ ID NO: 815 - DNA, 8 bp, Neisseria gonorrhoeae
  misc_feature (1)..(8): N = Unknown
nnnnnnnn

SEQ ID NO: 816 - protein, 366 aa, Neisseria gonorrhoeae
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVRGFTRPKSRSTAPCACCTRAIRSTSPRKKTTSSSSARPKSKAKAKPPPAYVPGWNSYPRSMPSTPPSAKPTSSKWRPGLRPTLNHHNPEIRYSRERRLIEINGLFRHGFMISPAVTAAAVRLAVALFDGKDAPERDEESGLAYIGRQD

SEQ ID NO: 817 - DNA, 1101 bp, Neisseria gonorrhoeae
atgacccgtatcgccgtcctcggaggcggcctttccggaaggctgaccgcattgcagcttgcagaacaaggttatcagattgaacttttcgacaagggcacccgccaaggcgaacacgccgccgcctatgttgccgccgcgatgctcgcgcctgcggcggaagcggtcgaggcaacgcccgaagtcatcaggctgggcaggcagagcattccgctttggcgcggcatccgatgccgtctgaacacgctcacgatgatgcaggaaaacggcagcctgattgtgtggcacgggcaggacaagccattatccagcgagttcgtccgccatctcaaacgcggcggcgtagcggatgacgaaatcgtccgttggcgcgccgatgaaatcgccgaacgcgaaccgcaactcggcggacgtttttcagacggcatctacctgccgaccgaaggccagctcgacgggcggcaaatattgtctgcacttgccgacgctttggacgaactgaacgtcccttgccattgggaacacgaatgcgccccccaagacctgcaagcccaatacgactgggtaatcgactgccggggctacggcgcgaaaaccgcgtggaaccaatcccccgagcacaccagcaccttgcgcggcatacgcggcgaagtggcgcgggtttacacgcccgaaatcacgctcaaccgccccgtgcgcctgctgcacccgcgctatccgctctacatcgccccgaaagaaaaccacgtcttcgtcatcggcgcgacccaaatcgaaagcgaaagccaagcccccgccagcgtacgttccgggctggaactcttatccgcgctctatgccgtccaccccgccttcggcgaagccgacatcctcgaaatcgccgccggcctgcgccccacgctcaaccaccacaaccccgaaatccgctacagccgcgaacgccgcctcatcgaaatcaacggccttttccggcacggctttatgatttcccccgccgtaaccgccgccgccgtcagattggcagtggcactgtttgacggaaaagacgcgcccgaacgtgatgaagaaagcggtttggcgtatatcggaagacaagattaa

SEQ ID NO: 818 - protein, 366 aa, Neisseria gonorrhoeae
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVARVYTPEITLNRPVRLLHPRYPLYIAPKENHVFVIGATQIESESQAPASVRSGLELLSALYAVHPAFGEADILEIAAGLRPTLNHHNPEIRYSRERRLIEINGLFRHGFMISPAVTAAAVRLAVALFDGKDAPERDEESGLAYIGRQD

SEQ ID NO: 819 - DNA, 452 bp, Neisseria meningitidis
atgactgataatcgggggtttacgctggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggaggtttaaacaaacatctaccaagtggccaagtttgccgattaaagaggcagaaggcttttgtatccgtttgaatggaatcgtcgcgcggggctttagacagtaaattcatgttgaaggcggtagccatagataaagataaaaatccttttattattaagatgaatgaaaatctagtaacctttaatttgcaagaagtccgccagttcgtgtagtgacgggctggattattttaaaggaaatgataaggactgcaagttacttaagtag

SEQ ID NO: 820 - protein, 150 aa, Neisseria meningitidis
  misc_feature (92)..(92): Xaa= any amino acid
MTDNRGFTLVELISVVLILSVLALIVYPSYRNYVEKAKINAVRAALLENAHFMEKFYLQNGRFKQTSTKWPSLPIKEAEGFCIRLNGIVARXALDSKFMLKAVAIDKDKNPFIIKMNENLVTFICKKSASSCSDGLDYFKGNDKDCKLLK

SEQ ID NO: 821 - DNA, 450 bp, Neisseria meningitidis
atgactgataatcgggggtttacgctggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggaggtttaaacaaacatctaccaagtggccaagtttgccgattaaagaggcagaaggcttttgtatccgtttgaatggaatcgcgcgcggggctttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 822 - protein, 149 aa, Neisseria meningitidis
MTDNRGFTLVELISVVLILSVLALIVYPSYRNYVEKAKINAVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 823 - DNA, 450 bp, Neisseria meningitidis
atgactgataatcgggggtttacgctggttgaattaatatcagtggtcttgatattgtctgtacttgctttaattgtttatccgagctatcgcaattatgttgagaaagcaaagataaatacagtgcgggcagccttgttagaaaatgcacattttatggaaaagttttatctgcagaatgggagatttaaacaaacatctaccaaatggccaagtttgccgattaaagaggcagaaggcttttgtatccgtttgaatggaatcgcgcgcggggccttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 824 - protein, 149 aa, Neisseria meningitidis
MTDNRGFTLVELISVVLILSVLALIVYPSYRNYVEKAKINTVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 825 - DNA, 450 bp, Neisseria gonorrhoeae
atgactgataatcgggggtttacactggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggagatttaaacaaacatctaccaaatggccaagtttgccgattaaagaggcagaaggcttttgtatccgtttgaatggaatcgcgcgcggggctttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaagtag

SEQ ID NO: 826 - protein, 149 aa, Neisseria gonorrhoeae
MTDNRGFTLVELISVVLILSVLALIVYPSYRNYVEKAKINAVRAAFLENAHFMEKFYLQNGRFKQTSTKWPSLPIKEAEGFCIRLNGIARGALDSKFMLKAVAIDKDKNPFIIKMNENLVTFICKKSASSCSDRLDYFKGNDKDCKLLK

SEQ ID NO: 827 - DNA, 734 bp, Neisseria meningitidis
gtgtcgctggcttcggtgattgcctctcaaatcttcctttacgaagatttcaaccaaatgcggaaaacccgtggagctatctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgctccgctcattagaggcgggaaacagctcggactgcctgccg

SEQ ID NO: 828 - protein, 244 aa, Neisseria meningitidis
VSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAPLIRGGKQLGLPA

SEQ ID NO: 829 - DNA, 1869 bp, Neisseria meningitidis
atgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcctttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaagggggatattgaaacaggaacacctccgcccgttgcccggcgcgccccttgctgcggaaaatcattttccggaaaccgtcctgaccctcggcgactcgcacgccggacacctgagggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcctgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaattccacaaacacgaacgcctgcttaaatcttcccacggcggcgcattgcagtag

SEQ ID NO: 830 - protein, 622 aa, Neisseria meningitidis
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTASSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSHGGALQ

SEQ ID NO: 831 - DNA, 1869 bp, Neisseria meningitidis
atgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcttttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatcctcttttgctgatattttgctgcaaaaaaacaaaatcgctacgggtgctgcgtaacatcagcatcatcctatttctgattttgactgccacatcgtttttgccaagcgggttttataccgatattctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaagggggatattgaaacaggaacacctccgcccgttgcccggcgcgccccttgctgcggaaaatcattttccggaaaccgtcctgaccctcggcgactcgcacgccggacacctgcgggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcccgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaatttcacaaacacgaacgcctgcttaaatcttctcgcgacggcgcattgcagtag

SEQ ID NO: 832 - protein, 622 aa, Neisseria meningitidis
MQAVRYRPEIDGLRAVAVLSVMIFHLNNRWLPGGFLGVDIFFVISGFLITGIILSEIQNGSFSFRDFYTRRIKRIYPAFIAAVSLASVIASQIFLYEDFNQMRKTVELSAVFLSNIYLGFQQGYFDLSADENPVLHIWSLAVEEQYYLLYPLLLIFCCKKTKSLRVLRNISIILFLILTATSFLPSGFYTDILNQPNTYYLSTLRFPELLAGSLLAVYGQTQNGRRQTANGKRQLLSSLCFGALLACLFVIDKHNPFIPGMTLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLILVGYNLYARGILKQEHLRPLPGAPLAAENHFPETVLTLGDSHAGHLRGFLDYVGSREGWKAKILSLDSECLVWVDEKLADNPLCRKYRDEVEKAEAVFIAQFYDLRMGGQPVPRFEAQSFLIPGFPARFRETVKRIAAVKPVYVFANNTSISRSPLREEKLKRFAANQYLRPIQAMGDIGKSNQAVFDLIKDIPNVHWVDAQKYLPKNTVEIYGRYLYGDQDHLTYFGSYYMGREFHKHERLLKSSRDGALQ

SEQ ID NO: 833 - DNA, 1869 bp, Neisseria gonorrhoeae
atgcaagctgtccgatacaggcctgaaattgacggattgcgggccgtcgccgtgctatccgtcattattttccacctgaataaccgctggctgcccggaggattcctgggggtggacattttctttgtcatctcgggattcctcattaccaacatcattctttctgaaatacagaacggttctttttctttccgggatttttatacccgcaggattaagcggatttatcctgcttttattgcggccgtgtccctggcttcggtgattgcttctcaaatcttcctttacgaagatttcaaccaaatgaggaaaaccatagagctttctacggtttttttgtccaatatttatttggggttccgattggggtatttcgatttgagtgccgacgagaaccccgtactgcatatctggtctttggcggtagaggaacagtattacctcctgtatcctcttttgctgatattctgttacaaaaaaaccaaatcactacgggtgctgcgtaatatcagcatcatcctgtttctgattttgaccgcatcatcgtttttgccggccgggttttataccgacatcctcaaccaacccaatacttattacctttcgacactgaggtttcccgagctgttggtgggttcgctgttggcggtttacgggcaaacgcaaaacggcagacggcaaacagaaaatggaaaacggcagttgctttcattactctgtttcggcgcattgcttgtctgcctgttcgtgatcgacaaacacgatccgtttatcccgggaataaccctgctccttccctgcctgctgacggcgctgcttatccggagtatgcaatacgggacacttccgacccgcatcctgtcggcaagccccatcgtatttgtcggcaaaatctcttattccctatacctgtaccattggatttttattgccttcgcccattacattacaggcgacaaacagctcggactgcctgccgtatcggcggttgccgcgttgacggccggattttccctgttgagctattatttgattgaacagccgcttagaaaacggaagatgaccttcaaaaaggcatttttctgcctttatctcgccccgtccctgatgcttgtcggttacaacctgtattcaagagggatattgaaacaggaacacctccgcccgctgcccggcacgcccgttgctgcggaaaataattttccggaaaccgtcttgaccctcggcgactcgcacgccggacacctgcgggggtttctggattatgtcggcggcagggaagggtggaaagctaaaatcctgtccctcgattcggagtgtttggtttgggtggatgagaagctggcagacaacccgttgtgccgaaaataccgggatgaagttgaaaaagccgaagctgttttcattgcccaattctatgatttgaggatgggcggccagcccgtgccgagatttgaagcgcaatccttcctgatacccgggttcaaagcccgattcagggaaaccgtcaagaggatagccgccgtcaaacctgtatatgtttttgcaaacaatacatcaatcagccgttctcccttgagggaggaaaaattgaaaagatttgctataaaccaatacctccggcctattcgggctatgggcgacatcggcaagagcaatcaggcggtctttgatttggttaaagatattcccaatgtgcattgggtggacgcacaaaaatacctgcccaaaaacacggtcgaaatacacggacgctatctttacggcgaccaagaccacctgacctatttcggttcttattatatggggcgggaatttcacaaacacgaacgcctgctcaagcattcccgaggcggcgcattgcagtag

SEQ ID NO: 834 - protein, 622 aa, Neisseria gonorrhoeae
MQAVRYRPEIDGLRAVAVLSVIIFHLNNRWLPGGFLGVDIFFVISGFLITNIILSEIQNGSFSFRDFYTRRIKRIYPAFIAAVSLASVIASQIFLYEDFNQMRKTIELSTVFLSNIYLGFRLGYFDLSADENPVLHIWSLAVEEQYYLLYPLLLIFCYKKTKSLRVLRNISIILFLILTASSFLPAGFYTDILNQPNTYYLSTLRFPELLVGSLLAVYGQTQNGRRQTENGKRQLLSLLCFGALLVCLFVIDKHDPFIPGITLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLMLVGYNLYSRGILKQEHLRPLPGTPVAAENNFPETVLTLGDSHAGHLRGFLDYVGGREGWKAKILSLDSECLVWVDEKLADNPLCRKYRDEVEKAEAVFIAQFYDLRMGGQPVPRFEAQSFLIPGFKARFRETVKRIAAVKPVYVFANNTSISRSPLREEKLKRFAINQYLRPIRAMGDIGKSNQAVFDLVKDIPNVHWVDAQKYLPKNTVEIHGRYLYGDQDHLTYFGSYYMGREFHKHERLLKHSRGGALQ

SEQ ID NO: 835 - DNA, 263 bp, Neisseria meningitidis
attatttacgaataccgctggatgtttctttacggcgcactgacgaccttggggctgacggtcgtggcaacgcgggcggttcggtattgggtctgttgttggcgttggcgcgcctgattcacttggaaaaagccggtgcgccgatgcgcgtgctggcgtgggcgttgcgtaaagtttcgctgctgtatgttacgctgttccggggtacgccgctgtttgtgcagattgtgatttgggcgtatgtgtggtttccgtttttcgtc

SEQ ID NO: 836 - protein, 88 aa, Neisseria meningitidis
  misc_feature (24)..(24): Xaa= any amino acid
IIYEYRWMFLYGALTTLGLTVVAXAGGSVLGLLLALARLIHLEKAGAPMRVLAWALRKVSLLYVTLFRGTPLFVQIVIWAYVWFPFFV

SEQ ID NO: 837 - DNA, 747 bp, Neisseria meningitidis
atggattttcgttttgacattatttacgaataccgctggatgtttctttacggcgcactgacgaccttggggctgacggtcgtggcaacggcgggcggttcggtattgggtctgttgttggcgttggcgcgcctgattcacttggaaaaagccggtgcgccgatgcgcgtgctggcgtgggcgttgcgtaaagtttcgctgctgtatgttacgctgttccggggtacgccgctgtttgtgcagattgtgatttgggcgtatgtgtggtttccgtttttcgtccatccttcagacggcattttggtcagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgcgttctttggggctgacctatccgcaggcgatgcgctatgtgattctgccgcaggcattgcgccgcatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgtcgccctgatttatctgttgatgacgactttcttaggctggatattcctgcgtttggaaaaacgttacaatccgcaacaccgctga

SEQ ID NO: 838 - protein, 248 aa, Neisseria meningitidis
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVHPSDGILVSGEAAIALRRGYGPLIAGSLALIANSGAYICEIFRAGIQSIDKGQMEAARSLGLTYPQAMRYVILPQALRRMLPPLASEFITLLKDSSLLSVIAVAELAYVQNTITGRYSVYEEPLYTVALIYLLMTTFLGWIFLRLEKRYNPQHR

SEQ ID NO: 839 - DNA, 747 bp, Neisseria meningitidis
atggattttcgttttgacattatttacgaataccgctggatgtttctttacggcgcactgacgaccttggggctgacggtcgtggcgacggcgggcggttcggtattgggtctgttgttggcgttggcgcgcctgattcacttggaaaaagccggtgcgccgatgcgcgtgctggcgtgggcgttgcgtaaggtttcgctgctgtatgttacgctgttccggggtacgccgctgtttgtgcagattgtgatttgggcgtatgtgtggtttccgtttttcgtccatccttcagacggcattttggttagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgcgttctttggggctgacctatccgcaggcgatgcgctatgtgattctgccgcaggcattgcgccgtatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgtcgccctgatttatctgttgatgacgactttcttaggctggatattcctgcgtttggaaaaacgttacaatccgcaacaccgctga

SEQ ID NO: 840 - protein, 248 aa, Neisseria meningitidis; identical to SEQ ID NO: 838

SEQ ID NO: 841 - DNA, 8 bp, Neisseria gonorrhoeae
  misc_feature (1)..(8): N = Unknown
nnnnnnnn

SEQ ID NO: 842 - protein, 174 aa, Neisseria gonorrhoeae
MDFRFDIIYEYRWMFLYGALTTLGLTVVATAGGSVLGLLLALARLIHLEKAGAPMRVLAWALRKVSLLYVTLFRGTPLFVQIVIWAYVWFPFFVILHTAFLGNAMRQSRRVPDKGRWIAGSLELNCQPRGRKTRGEFPPGESNLGTEPRNPLSMGQRRFPGCENWYPPQNFIKK

SEQ ID NO: 843 - DNA, 747 bp, Neisseria gonorrhoeae
atggattttcgttttgacattatttacgaataccgctggatgtttctttacggcgcactgacgaccttggggctgacggtcgtggcgacggcgggcggttcggtattgggtctgttgttggcgttggcgcgcctgattcacttggaaaaagccggtgcgccgatgcgcgtgctggcgtgggcgttgcgtaaggtttcgctgctgtacgttaccctgttccggggtacgccgctgtttgtgcagattgtgatttgggcgtatgtgtggtttccgtttttcgtccatccttcagacggcattttggtcagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgtgttctttgggactgacctatccgcaggcgatgcgctatgtgattctgccgcaggcattgcgccgtatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgccgccctgatttatctgttgatgacgactttcttaggctggatattcctgcgtttggaaaaacgttacaatccgcaacaccgctga

SEQ ID NO: 844 - protein, 248 aa, Neisseria gonorrhoeae; identical to SEQ ID NO: 838

SEQ ID NO: 845 - DNA, 583 bp, Neisseria meningitidis
ctgaaagaatgccgtctgaaagaccctgtttttattccaaatatcgtttataagaacatcgccattactttcctgctcttgcacgccgccgccgaactttggctgcccgcgcaaaccgccggttttaccgcgctcgccgtcggcttcatcctgctcgccaagctgcgtgagcttcaccatcacgaactcttacgtaaacactacgtccgcacttattacytgctccaactctttgccgccgcaggctagtttgtggacaggcgcggcgwaattacaaaacctgcccgcytccgcgcccctgcacctgattaccctcggcggcatgatgggcggcgtgatgatggtgtggctgaccgccggactgtggcacagcggctttaccaaactcgactaccccaaactctgccgcattgccgtccccatccttttcgccgccgccgtctcgcgcgctttcttgrtgaacgtgaacccgrtatttttcattaccgttcctgcgattctgaccgccgccgtattcgtactgtatcttttcrcgtttataccgatatttcgggcgaatgcgtttacagacgatccggartar

SEQ ID NO: 846 - protein, 193 aa, Neisseria meningitidis
  misc_feature (90)..(90): Xaa= any amino acid
  misc_feature (153)..(153): Xaa= any amino acid
  misc_feature (158)..(158): Xaa= any amino acid
  misc_feature (178)..(178): Xaa= any amino acid
LKECRLKDPVFIPNIVYKNIAITFLLLHAAAELWLPAQTAGFTALAVGFILLAKLRELHHHELLRKHYVRTYYLLQLFAAAGSLWTGAAXLQNLPASAPLHLITLGGMMGGVMMVWLTAGLWHSGFTKLDYPKLCRIAVPILFAAAVSRAFLXNVNPXFFITVPAILTAAVFVLYLFXFIPIFRANAFTDDPE

SEQ ID NO: 847 - DNA, 1074 bp, Neisseria meningitidis
atgcggccgtttttcgtcggcgcggcggtgcttgccatactcggtgcgctggtgtttttcatcaaccccggtgccatcgtcctgcaccgccaaattttcttggaacttatgctgccggcggcatacggcggttttttgactgcggctttgttggactggacgggtttttcgggtaacctgaaacctgtcgcgactttgatggcggcattattgctcgccgcatccgctatactgcccttttcgccgcaaactgcctcgtttttcgtcgccgcctattggctggtgttgctgctgttctgcgcccggctgatttggctagaccgaaacaccgacaacttcgccctgctaatgttacttgccgcgttcactgtttttcagacggcatatgccgtcagcggcgatttgaacctgttgcgcgcgcaagtgcatctaaatatggcggcggtgatgttcgtatccgtgcgcgtcagtattcttttgggcgcggaagccctgaaagaatgccgtctgaaagaccctgtttttattccaaatatcgtttataaaaacatcgccattactttcctgctcttgcacgccgccgccgaactttggctgcccgcgcaaaccgccggttttaccgcgctcgccgtcggcttcatcctgctcgccaagctgcgtgagcttcaccatcacgaactcttacgtaaacactacgtccgcacttattacctgctccaactctttgccgccgcaggctatttgtggacaggcgcggcgaaattacaaaacctgcccgcctccgcgcccctgcacctgattaccctcggcggcatgatgggcggcgtgatgatggtgtggctgaccgccggactgtggcacagcggctttaccaaactcgactaccccaaactctgccgcattgccgtccccatccttttcgccgccgccgtctcgcgcgctttcttgatgaacgtgaacccgatatttttcattaccgttcctgcgattctgaccgccgccgtattcgtactgtatcttttcacgtttataccgatatttcgggcgaatgcgtttacagacgatccggaataa

SEQ ID NO: 848 - protein, 357 aa, Neisseria meningitidis
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNIVYKNIAITFLLLHAAAELWLPAQTAGFTALAVGFILLAKLRELHHHELLRKHYVRTYYLLQLFAAAGYLWTGAAKLQNLPASAPLHLITLGGMMGGVMMVWLTAGLWHSGFTKLDYPKLCRIAVPILFAAAVSRAFLMNVNPIFFITVPAILTAAVFVLYLFTFIPIFRANAFTDDPE

SEQ ID NO: 849 - DNA, 1074 bp, Neisseria meningitidis
  misc_feature (918)..(918): N= Unknown
atgcggccgtttttcgtcggcgcggcggtgcttgccatactcggtgcgctggtgtttttcatcaaccccggtgccatcgtcctgcaccgccaaattttcttggaacttatgctgccggcggcatacggcggttttttgactgcggctttgttggactggacgggtttttcgggtaacctgaaacctgtcgcgactttgatggcggcattattgctcgccgcatccgctatactgcccttttcgccgcaaactgcctcgtttttcgtcgccgcctattggctggtgttgctgctgttctgcgcccggctgatttggctagaccgaaacaccgacaacttcgccctgctaatgttacttgccgcgttcactgtttttcagacggcatatgccgtcagcggcgatttgaacctgttgcgcgcgcaagtgcatctaaatatggcggcggtgatgttcgtatccgtgcgcgtcagtattcttttgggcgcggaagccctgaaagaatgccgtctgaaagacccagtattcatccccaatgtcgtctataaaaacatcgccattaccttcctgctcctgcacgccgccgccgaactttggctgcctgcgcaaaccgccggttttacctcgctcgccgtcggctttatcctgcttgccaagctgcgtgagcttcaccatcacgaactcctgcgcaaacactacgtccgcacttattacctgctccaactctttgccgccgcaggctatttgtggacaggcgcggcgaaattacaaaacctgcccgcctccgcgcccctgcacctgattaccctcggtggcatgatgggcagcgtgatgatggtgtggctgactgccggactgtggcacagcggctttaccaagctcgactacccgaaactctgccgcatcgccgtccccatcctnttcgccgccgccgtttcgcgcgctgttttaatgaacgtaaacccgatattcttcatcaccgtccccgcaattctgaccgccgccgtgttcgtgctttacctgctgacattcgtaccgatctttcgggcgaacgcgtttacagacgatccggaataa

SEQ ID NO: 850 - protein, 357 aa, Neisseria meningitidis
MRPFFVGAAVLAILGALVFFINPGAIVLHRQIFLELMLPAAYGGFLTAALLDWTGFSGNLKPVATLMAALLLAASAILPFSPQTASFFVAAYWLVLLLFCARLIWLDRNTDNFALLMLLAAFTVFQTAYAVSGDLNLLRAQVHLNMAAVMFVSVRVSILLGAEALKECRLKDPVFIPNVVYKNIAITFLLLHAAAELWLPAQTAGFTSLAVGFILLAKLRELHHHELLRKHYVRTYYLLQLFAAAGYLWTGAAKLQNLPASAPLHLITLGGMMGSVMMVWLTAGLWHSGFTKLDYPKLCRIAVPILFAAAVSRAVLMNVNPIFFITVPAILTAAVFVLYLLTFVPIFRANAFTDDPE

SEQ ID NO: 851 - DNA, 8 bp, Neisseria gonorrhoeae
  misc_feature (1)..(8): N = Unknown
nnnnnnnn

SEQ ID NO: 852 - protein, 364 aa, Neisseria gonorrhoeae
MNKFFTHPMRPFFVGAAVLAILGALVFFHQPRRYHPAPPNFLGTYAAGCIRRFFDYRFVGPDGFFRQPETCRYFDGGVVACCGCFIAVFTATCRIFRRRLLAGVAAVLRLADLARRQHRTLRSVDVTAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 853 - DNA, 1071 bp, Neisseria gonorrhoeae
atgcgcccgtttttcgtcggtgcggcagtacttgccatactcggtgcgttggtgttttttatcaaccccggcgctatcatcctgcaccgccaaattttcttggaacttatgctgccggctgcatacggcggttttttgactaccgctttgttggaccggacgggtttttcaggcaacctgaaacctgccgctactttgatggcggtgttgttgcttgttgcggctgttttattgccgtttttaccgcaacttgccgcatttttcgtcgccgcctattggctggtgttgctgctgttctgcgcctggctgatttggctcgaccgcaacaccgacaacttcgctctgttgatgttacttgccgcatttaccgtttttcagacggcctatgccgtcagcggcgatttgaacttactgcgcgcgcaagtgcatttgaatatggcggcggtcatgttcgtatccgtccgcgtcagcgtccttttgggcacggaaaccctgaaagaatgccgtctgaaagaccccgtattcatccccaacgttatctataaaaacatcgccatcaccctgctgctgcacgccgccgccgaactttggctgcccgcgcaaaccgccggttttactgcgcttgccgtcggcttcatcctgctcgccaagctgcgcgaactgcaccatcacgaactcttacgcaaacactacgtccgcacttattacctgctccagctctttgccgccgcaggttatctgtggacaggcgcggcgaaactgcaaaacctgcccgcctccgcgcccctgcacctgattaccctcggcggcatgacgggtggcgtgatgatggtgtggctgactgccggactgtggcacagcggctttaccaaactcgactacccgaaactctgccgcatcgccgtctccatccttttcgcctccgccgtttcgcgcgctgttttaatgaacgtgaatccgatattcttcatcaccgttcccgagattctgaccgccgccgtgttcatgctttacctgctgacgttcgtaccgatttttcgagcgaacgcgtttacagacgatccggaataa

SEQ ID NO: 854 - protein, 356 aa, Neisseria gonorrhoeae
MRPFFVGAAVLAILGALVFFINPGAIILHRQIFLELMLPAAYGGFLTTALLDRTGFSGNLKPAATLMAVLLLVAAVLLPFLPQLAAFFVAAYWLVLLLFCAWLIWLDRNTDNFALLMLLAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 855 - DNA, 362 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatagttccgtcagggcaaacgaatatgaatccgcacaacaatcttacttttacaggaaaatagggaagtttgaagctgcgggctggattggcgtacgcgtgacggcaaacctttgattgagacgttcaaacagggaggatttgactgcttggaaaag

SEQ ID NO: 856 - protein, 121 aa, Neisseria meningitidis
  misc_feature (94)..(94): Xaa= any amino acid
MEIRAIKYTAMAALLAFTVAGCRLAGWYECSSLTGWCKPRKPAAIDFWDIGGESPPSLGDYEIPLSDGNSSVRANEYESAQQSYFYRKIGKFEXCGLDWRTRDGKPLIETFKQGGFDCLEK

SEQ ID NO: 857 - DNA, 408 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaa

SEQ ID NO: 858 - protein, 135 aa, Neisseria meningitidis
MEIRAIKYTAMAALLAFTVAGCRLAGWYECSSLTGWCKPRKPAAIDFWDIGGESPPSLGDYEIPLSDGNRSVRANEYESAQQSYFYRKIGKFEACGLDWRTRDGKPLIETFKQGGFDCLEKQGLRRNGLSERVRW

SEQ ID NO: 859 - DNA, 408 bp, Neisseria meningitidis
atggaaattcgggcaataaaatatacggcaatggctgcgttgcttgcatttacggttgcaggctgccggttggcaggttggtatgagtgttcgtccctgtccggctggtgtaagccgagaaaacctgccgccatcgatttttgggatattggcggcgagagtcctccgtctttagaggactacgagataccgctttcagacggcaatcgttccgtcagggcaaacgaatatgaatccgcacaacaatcttacttttacaggaaaatagggaagtttgaagcctgcgggttggattggcgtacgcgtgacggcaaacctttgattgagacgttcaaacaggaaggttttgattgtttgaaaaagcaggggttgcggcgcaacggtctgtccgagcgcgtccgatggtaa

SEQ ID NO: 860 - protein, 135 aa, Neisseria meningitidis
MEIRAIKYTAMAALLAFTVAGCRLAGWYECSSLSGWCKPRKPAAIDFWDIGGESPPSLEDYEIPLSDGNRSVRANEYESAQQSYFYRKIGKFEACGLDWRTRDGKPLIETFKQEGFDCLKKQGLRRNGLSERVRW

SEQ ID NO: 861 - DNA, 8 bp, Neisseria gonorrhoeae
  misc_feature (1)..(8): N = Unknown
nnnnnnnn

SEQ ID NO: 862 - protein, 135 aa, Neisseria gonorrhoeae
MEIRVIKYTATAALFAFTVAGCRLAGWYECLSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 863 - DNA, 408 bp, Neisseria gonorrhoeae
atggaaattcgggtaataaaatatacggcaacggctgcgttgtttgcatttacggttgcaggctgccggctggcggggtggtatgagtgttcgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 864 - protein, 135 aa, Neisseria gonorrhoeae
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 865 - DNA, 776 bp, Neisseria meningitidis
atgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggca

SEQ ID NO: 866 - protein, 259 aa, Neisseria meningitidis
  misc_feature (142)..(142): Xaa= any amino acid
  misc_feature (183)..(183): Xaa= any amino acid
  misc_feature (225)..(225): Xaa= any amino acid
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVXGKFRRFRPPAANAAPRPEQPIAVFRHRSRRIRHRLFRQTFXIRALPSAYRRVEQSGIRPRRHLCRLGRDTDPVPLPRAYRAVXRLNRLQRTAAKPARYFGQRLLDAGGKIRHGTRLA

SEQ ID NO: 867 - DNA, 1377 bp, Neisseria meningitidis
atgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggcaggccggcgaagccaatgccgacggctcgttcgacgtgttgctcgacggcaaaaccgccggacgcgtcaaatgggatttgatgggcaggcacaaccgcatgaacgcgctcgccgtcattgccgccgcgcgtcatgtcggtgtcgatattcagaccgcctgcgaagccttgggcgcgtttaaaaacgtcaaacgccggatggaaatcaaaggcacggcaaacggcatcaccgtttacgacgacttcgcccaccacccgaccgccatcgaaaccacgattcaaggtttgcgccaacgcgtcggcggcgcgcgcatcctcgccgtcctcgaaccgcgttccaacacgatgaagctgggcacgatgaagtccgccctgcctgtaagcctcaaagaagccgaccaagtgttctgctacgccggcggcgtggactgggacgtcgccgaagccctcgcgcctttgggcggcaggctgaacgtcggcaaagacttcgatgccttcgttgccgaaatcgtgaaaaacgccgaagtaggcgaccatattttggtgatgagcaacggcggtttcggcggaatacacggaaagctgctggaagctttgagatag

SEQ ID NO: 868 - protein, 458 aa, Neisseria meningitidis
MKHIHIIGIGGTFMGGLAAIAKEAGFEVSGCDAKMYPPMSTQLEALGIDVYEGFDAAQLDEFKADVYVIGNVAKRGMDVVEAILNLGLPYISGPQWLSENVLHHHWVLGVAGTHGKTTTASMLAWVLEYAGLAPGFLIGGVPENFGVSARLPQTPRQDPNSQSPFFVIEADEYDTAFFDKRSKFVHYRPRTAVLNNLEFDHADIFADLGAIQTQFHYLVRTVPSEGLIVCNGRQQSLQDTLDKGCWTPVEKFGTEHGWQAGEANADGSFDVLLDGKTAGRVKWDLMGRHNRMNALAVIAAARHVGVDIQTACEALGAFKNVKRRMEIKGTANGITVYDDFAHHPTAIETTIQGLRQRVGGARILAVLEPRSNTMKLGTMKSALPVSLKEADQVFCYAGGVDWDVAEALAPLGGRLNVGKDFDAFVAEIVKNAEVGDHILVMSNGGFGGIHGKLLEALR

SEQ ID NO: 869 - DNA, 1377 bp, Neisseria meningitidis
  misc_feature (82)..(82): N= Unknown
  misc_feature (301)..(301): N= Unknown
  misc_feature (319)..(320): N= Unknown
  misc_feature (335)..(335): N= Unknown
  misc_feature (409)..(409): N= Unknown
  misc_feature (888)..(888): N= Unknown
  misc_feature (918)..(918): N= Unknown
  misc_feature (1185)..(1185): N= Unknown
atgaaacacatccacattatcggtatcggcggcacgtttatgggtgggattgccgccattgccaaagaagcagggtttgaantcagcggttgcgatgcgaagatgtatccgccgatgagcacccagctcgaagccttgggcataggcgtgtatgaaggcttcgacaccgcgcagttggacgaatttaaagccgacgtttacgttatcggcaatgtcgccaagcgcgggatggatgtggttgaagcgattttgaaccgtgggctgccttatatttccggcccgcaatggctggctgaaaacntgctgcaccatcattggnnactcggcgtggcggngacgcacggcaaaacgaccaccgcgtctatgctcgcgtgggttttggaatatgccggactcgcaccgggcttcnttatcggcggcgtaccggaaaacttcagcgtttccgcccgcctgccgcaaacgccgcgccaagacccgaacagccaatcgccgtttttcgtcattgaagccgacgaatacgacaccgcgtttttcgacaaacgctccaaattcgtgcattaccgtccgcgtaccgccgtgttgaacaatctggaattcgaccacgccgacatcttcgccgatttgggcgcgatacagacccagttccaccacctcgtgcgtaccgtgccgtctgaaggcctcatcgtctgcaacggacggcagcaaagcctgcaagacactttggacaaaggctgctggacgccggtggaaaaattcggcacggaacacggctggcaggccggcgaagccaatgccgatggctcgttcgacgtgttgcttgacggcaaaaaagccggacacgtcgcttggagtttgatgggcggacacaaccgcatgaacgcgctcgcngtcatcgccgccgcgcgtcatgccggagtngacattcagacggcctgcgaagccttgagcacgtttaaaaacgtcaaacgccgcatggaaatcaaaggcacggcaaacggtatcaccgtttacgacgacttcgcccaccatccgaccgctatcgaaaccacgattcaaggtttgcgccagcgcgtcggcggcgcgcgcatcctcgccgtcctcgaaccgcgttccaatacgatgaagctgggtacgatgaaagccgccctgcccgcaagcctcaaagaagccgaccaagtgttctgntacgccggcggcgcggactgggacgttgccgaagccctcgcgcctttgggcggcaggctgcacgtcggcaaagacttcgatgccttcgttgccgaaatcgtgaaaaacgccgaagcaggcgaccatattttggtgatgagcaacggcggtttcggcggaatacacaccaaactgctggacgctttgagatag

SEQ ID NO: 870 - protein, 458 aa, Neisseria meningitidis
  misc_feature (28)..(28): Xaa= any amino acid
  misc_feature (101)..(101): Xaa= any amino acid
  misc_feature (107)..(107): Xaa= any amino acid
  misc_feature (112)..(112): Xaa= any amino acid
  misc_feature (137)..(137): Xaa= any amino acid
  misc_feature (395)..(395): Xaa= any amino acid
MKHIHIIGIGGTFMGGIAAIAKEAGFEXSGCDAKMYPPMSTQLEALGIGVYEGFDTAQLDEFKADVYVIGNVAKRGMDVVEAILNRGLPYISGPQWLAENXLHHHWXLGVAXTHGKTTTASMLAWVLEYAGLAPGFXIGGVPENFSVSARLPQTPRQDPNSQSPFFVIEADEYDTAFFDKRSKFVHYRPRTAVLNNLEFDHADIFADLGAIQTQFHHLVRTVPSEGLIVCNGRQQSLQDTLDKGCWTPVEKFGTEHGWQAGEANADGSFDVLLDGKKAGHVAWSLMGGHNRMNALAVIAAARHAGVDIQTACEALSTFKNVKRRMEIKGTANGITVYDDFAHHPTAIETTIQGLRQRVGGARILAVLEPRSNTMKLGTMKAALPASLKEADQVFXYAGGADWDVAEALAPLGGRLHVGKDFDAFVAEIVKNAEAGDHILVMSNGGFGGIHTKLLDALR

SEQ ID NO: 871 - DNA, 8 bp, Neisseria gonorrhoeae
  misc_feature (1)..(8): N = Unknown
nnnnnnnn

SEQ ID NO: 872 - protein, 261 aa, Neisseria gonorrhoeae
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPGKFRRFRPPTANAASRPEQQIAVFRHRSRRIRHRLFRQTLQIRALSPAYRRVEQSGIRPRRHLRRLGRDTDPVPPPRAHRTIRRPHRLQRTAAKPARYFGQRLLDAGGKIRHRTRLADW

SEQ ID NO: 873 - DNA, 1377 bp, Neisseria gonorrhoeae
atgaaacacatccacattatcggtatcggcggcacgtttatgggcgggattgccgccattgccaaagaagccgggttcaaagtcagcggttgcgacgcgaagatgtatccgccgatgagcacccagctcgaagccttgggcataggcgtacacgaaggcttcgatgccgcgcagttggaagaatttcaagccgatatttacgtcatcggcaatgtcgccaggcgcgggatggatgtggtcgaggcgattttgaaccgtgggctgccttatatttccggcccgcaatggctggctgaaaacgtgctgcaccatcattgggtactcggcgtggcagggacgcacggcaaaacgaccaccgcgtccatgctcgcctgggtcttggaatatgccggactcgcgccgggcttcctcatcggcggtgtaccggaaaatttcggcgtttccgcccgcctaccgcaaacgccgcgtcaagacccgaacagcaaatcgccgtttttcgtcatcgaagccgacgaatacgacaccgcctttttcgacaaacgctccaaattcgtgcattatcgcccgcgtaccgccgtgttgaacaatctggaattcgaccacgccgacatcttcgccgacttgggcgcgatacagacccagttccaccacctcgtgcgcaccgtaccatccgaaggcctcatcgtctgcaacggacagcagcaaagcctgcaagatactttggacaaaggctgctggacgccggtggaaaaattcggcaccggacacggctggcagattggtgaagtcaatgccgacggctcgttcgacgtattgcttgacggcaaaaaagccggacacgtcgcatgggatttgatgggcggacacaaccgcatgaacgcgctcgccgtcatcgctgccgcacgccatgccggagtcgatgttcagacggcctgcgaagccttgggtgcgtttaaaaacgtcaaacgccgcatggaaatcaaaggcacggcaaacggcatcaccgtttacgacgatttcgcccaccacccgaccgccatcgaaaccacgattcaaggtttgcgccaacgtgtcggcggcgcgcgcatcctcgccgtcctcgagccgcgttccaacaccatgaaactcggcacgatgaagtccgccctgcccgcaagcctcaaagaagccgaccaagtgttctgctacgccggcggcgcggactgggacgttgccgaagccctcgcgcctttgggctgcaggctgcgcgtcggtaaagatttcgataccttcgttgccgaaattgtgaaaaacgcccgaaccggcgaccatattttggtgatgagcaacggcggtttcggcggaatacacaccaaactgctggacgctttgagatag

SEQ ID NO: 874 - protein, 458 aa, Neisseria gonorrhoeae
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPENFGVSARLPQTPRQDPNSKSPFFVIEADEYDTAFFDKRSKFVHYRPRTAVLNNLEFDHADIFADLGAIQTQFHHLVRTVPSEGLIVCNGQQQSLQDTLDKGCWTPVEKFGTGHGWQIGEVNADGSFDVLLDGKKAGHVAWDLMGGHNRMNALAVIAAARHAGVDVQTACEALGAFKNVKRRMEIKGTANGITVYDDFAHHPTAIETTIQGLRQRVGGARILAVLEPRSNTMKLGTMKSALPASLKEADQVFCYAGGADWDVAEALAPLGCRLRVGKDFDTFVAEIVKNARTGDHILVMSNGGFGGIHTKLLDALR

SEQ ID NO: 875 - DNA, 1181 bp, Neisseria meningitidis
  misc_feature (511)..(534): N= Unknown
ccgggctattacggctcggatgacgaatttaagcgggcattcggagaaaactcgccgacatmcaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcratacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcratttcawagacaaagtgcatcaannnnnnnnnnnnnnnnnnnnnnnntacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgattttwgattttaacgccgcttacgagccgaagaaaaaccttattttccgcgccgaagtcaaaaatctgttcgacaggcgttatatcgatccgctcgatgcgggcaatgatgcggcaacgagcgttattacagctcgttcgacccgaaagacaaggacrragacgtaacgtgtaatgctgataaaacgttgtgcaacggcaaatacggcggcacaagcaaaagcgtattgaccaattttgcacgcggacgcacctttttgatgacgatgagctacaagttttaa

SEQ ID NO: 876 - protein, 393 aa, Neisseria meningitidis
  misc_feature (21)..(21): Xaa= any amino acid
  misc_feature (104)..(104): Xaa= any amino acid
  misc_feature (163)..(163): Xaa= any amino acid
  misc_feature (165)..(165): Xaa= any amino acid
  misc_feature (171)..(178): Xaa= any amino acid
  misc_feature (301)..(301): Xaa= any amino acid
  misc_feature (339)..(339): Xaa= any amino acid
  misc_feature (353)..(353): Xaa= any amino acid
PGYYGSDDEFKRAFGENSPTXKKHCNRSCGIYEPVLKKYGKKRANNHSVSISADFGDYFMPFASYSRTHRMPNIQEMYFSQIGDSGVHTALKPERANTWQFGFXTYKKGLLKQDDTLGLKLVGYRSRIDNYIHNVYGKWWDLNGDIPSWVSSTGLAYTIQHRXFXDKVHQXXXXXXXXYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIXDFNAAYEPKKNLIFRAEVKNLFDRRYIDPLDAGNDAAXERYYSSFDPKDKDXDVTCNADKTLCNGKYGGTSKSVLTNFARGRTFLMTMSYKF

SEQ ID NO: 877 - DNA, 2667 bp, Neisseria meningitidis
  misc_feature (835)..(835): N= Unknown
gaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctgncaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaa

SEQ ID NO: 878 - protein, 888 aa, Neisseria meningitidis
  misc_feature (279)..(279): Xaa= any amino acid
EAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWERDLQRQQWKYKPYKNYNNQELQKYIEEHDKSWRENLXPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 879 - protein, 2616 aa, Neisseria meningitidis
AAAGACAAAAAAGTGTTTACCGATGCGCGTGCCGTATCGACCCGTCAGGATATATTCAAATCCANCGAAAACCTCGACAACATCGTACGCANCATCCCCGGTGCGTTTACACANCAANATAAAAGCTCGGGCNTTGTGTCTTTGAATATTCGCNGCGACAGCGGGTTCGGGCGGGTCAATACNATGGTNGACGGCATCACNCANACCTTTTATTCGACTTCTACCGATGCGGGCAGGGCAGGCGGTTCATCTCAATTCGGTGCATCTGTCGACAGCAATTTTATNGCCGGACTGGATGTCGTCAAAGGCAGCTTCAGCGGCTCGGCAGGCATCAACAGCCTTGCCGGTTCGGCGAATCTGCGGACTTTANGCGTGGATGATGTCGTTCAGGGCAATANTACNTACGGCCTGCTGCTAAAAGGTCTGACCGGCACCAATTCAACCAAAGGTAATGCGATGGCGGCGATAGGTGCGCGCAAATGGCTGGAAAGCGGAGCATCTGTCGGTGTGCTTTACGGGCACAGCAGGCGCAGCGTGGCGCAAAATTACCGCGTGGGCGGCGGCGGGCAGCACATCGGAAATTTTGGCGCGGAATATCTGGAACGACGCAAGCAACGATATTTTGAGCAAGAAGGCGGGTTGAAATTCAATTCCAACAGCGGAAAATGGGAGCGGGATTTCCAAAAGTCGTACTGGAAAACCAAGTGGTATCAAAAATACGATGCCCCCCAAGAACTGCAAAAATACATCGAAGGTCATGATAAAAGCTGGCGGGAAAACCTGGCGCCGCAATACGACATCACCCCCATCGATCCGTCCAGCCTGAAGCNGCAGTCGGCAGGCAACCTGTTTAAATTGGAATACGACGGCGTATTCAATAAATACACGGCGCAATTTCGCGATTTAAACACCAAAATCGGCAGCCGCAAAATCATCAACCGCAATTATCAATTCAATTACGGTTTGTCTTTGAACCCGTATACCAACCTCAATCTGACCGCAGCCTACAATTCGGGCAGGCAGAAATATCCGAAAGGGTCGAAGTTTACAGGCTGGGGGCTTTTNAAAGATTTTGAAACCTACAACAACGCAAAAATCCTCGACCTCANCAACACCTCCACCTTCCGGCTGCCCCGTGAAACCGAGTTGCAAACCACTTTGGGCTTCAATTATTTCCACAACGAATACGGCAAAAACCGCTTTCCTGAAGAATTGGGGCTGTTTTTCGACGGTCCGGATCANGACAACGGGCTTTATTCCTATTTGGGGCGGTTTAAGGGCGATAAAGGGCTGCTGCCCCAAAAATCAACCATTGTCCAACCGGCCGGCAGCCAATATTTCAACACGTTCTACTTCGATGCCGCGCTCAAAAAAGACATTTACCGCTTAAACTACAGCACCAATACCGTCGGCTACCGTTTCGGCGGCNAATATACGGGCTATTACNGCTCGGATGACGAATTTAAGCGGGCATTCGGAGAAAACTCGCCGACATACANGAAACATTGCAACCAGAGCTGCGGAATTTATGAACCCGTATTGAAAAAATACGGCAAAAAGCGCGCCAACAACCATTCGGTCAGCATTAGTGCGGACTTCGGCGATTATTTCATGCCGTTCGCCAGCTATTCGCGCACACACCGTATGCCCAACATCCAAGAAATGTATTTTTCCCAAATCGGCGACTCCGGCGTTCACACCGCCTTAAAACCAGAGCGCGCAAACACTTGGCAATTTGGCTTCAATACCTATAAAAAAGGATTGTTAAAACAAGATGATATATTAGGATTAAAACTGGTCGGCTACCGCAGCCGCATCGACNACTACATCCACAACGTTTACGGGAAATGGTGGGATTTGAACGGGAATATTCCGAGCTGGGTCAGCAGCACCGGGCTTGCCTACACCATCCAACACCGCAATTTCAAAGACAAAGTGCACAAACACGGTTTTGAGTTGGAGCTGAATTACGATTATNGGCGTTTTTTCACCAACCTTTCTTACGCCTATCAAAAAAGCACGCAACCGACCAACTTCAGCGATGCGAGCGAATCGCCCAACAATGCGTCCAAAGAAGACCAACTCAAACAAGGTTATGGGTTGAGCAGGGTTTCCGCCCTGCCGCGAGATTACGGACGTTTGGAAGTCGGTACGCGCTGGTTGGGCAACAAACTGACTTTGGGCGGCGCGATGCGCTATTTCGGCAAGAGCATCCGCGCGACGGCTGAAGAACGCTATATCGACGNCACCAATGGGGNANNTACCAGCAATTTCCGGCAACTGGGCAAGCGTTCCATCANACAAACCGAAACCCTTGCCCGCCAGCCTTTGATTTTTGATTTNTACGCCGCTTACGAGCCGAAGAAAAANCTTATTTTCCGCGCCGAAGTCAAAAATCTGTTCGACAGGCGTTATATCGATCCGCTCGATGCGGGCAATGATGCGGCAACGCAGCGTTATTACAGTTCGTTCGACCCGAAAGACAAGGACGAAGAAGTAACGTGTAATGATGATAACACGTTATGCAACGGCAAATACGGCGGCACAAGCAAAAGCGTATTGACCAATTTTGCACGCGGACNCACCTTTTTGATAACGATGAGCTACAAGTTTTAA

SEQ ID NO: 880 - protein, 871 aa, Neisseria meningitidis
  misc_feature (22)..(22): Xaa= any amino acid
  misc_feature (31)..(31): Xaa= any amino acid
  misc_feature (38)..(38): Xaa= any amino acid
  misc_feature (40)..(40): Xaa= any amino acid
  misc_feature (45)..(45): Xaa= any amino acid
  misc_feature (52)..(52): Xaa= any amino acid
  misc_feature (68)..(68): Xaa= any amino acid
  misc_feature (95)..(95): Xaa= any amino acid
  misc_feature (124)..(124): Xaa= any amino acid
  misc_feature (133)..(133): Xaa= any amino acid
  misc_feature (277)..(277): Xaa= any amino acid
  misc_feature (355)..(355): Xaa= any amino acid
  misc_feature (370)..(370): Xaa= any amino acid
  misc_feature (414)..(414): Xaa= any amino acid
  misc_feature (477)..(477): Xaa= any amino acid
  misc_feature (483)..(483): Xaa= any amino acid
  misc_feature (500)..(500): Xaa= any amino acid
  misc_feature (608)..(608): Xaa= any amino acid
  misc_feature (660)..(660): Xaa= any amino acid
  misc_feature (749)..(749): Xaa= any amino acid
  misc_feature (753)..(754): Xaa= any amino acid
  misc_feature (767)..(767): Xaa= any amino acid
  misc_feature (781)..(781): Xaa= any amino acid
  misc_feature (790)..(790): Xaa= any amino acid
  misc_feature (861)..(861): Xaa= any amino acid
KDKKVFTDARAVSTRQDIFKSXENLDNIVRXIPGAFTXQXKSSGXVSLNIRXDSGFGRVNTMVDGITXTFYSTSTDAGRAGGSSQFGASVDSNFXAGLDVVKGSFSGSAGINSLAGSANLRTLXVDDVVQGNXTYGLLLKGLTGTNSTKGNAMAAIGARKWLESGASVGVLYGHSRRSVAQNYRVGGGGQHIGNFGAEYLERRKQRYFEQEGGLKFNSNSGKWERDFQKSYWKTKWYQKYDAPQELQKYIEGHDKSWRENLAPQYDITPIDPSSLKXQSAGNLFKLEYDGVFNKYTAQFRDLNTKIGSRKIINRNYQFNYGLSLNPYTNLNLTAAYNSGRQKYPKGSKFTGWGLXKDFETYNNAKILDLXNTSTFRLPRETELQTTLGFNYFHNEYGKNRFPEELGLFFDGPDXDNGLYSYLGRFKGDKGLLPQKSTIVQPAGSQYFNTFYFDAALKKDIYRLNYSTNTVGYRFGGXYTGYYXSDDEFKRAFGENSPTYXKHCNQSCGIYEPVLKKYGKKRANNHSVSISADFGDYFMPFASYSRTHRMPNIQEMYFSQIGDSGVHTALKPERANTWQFGFNTYKKGLLKQDDILGLKLVGYRSRIDXYIHNVYGKWWDLNGNIPSWVSSTGLAYTIQHRNFKDKVHKHGFELELNYDYXRFFTNLSYAYQKSTQPTNFSDASESPNNASKEDQLKQGYGLSRVSALPRDYGRLEVGTRWLGNKLTLGGAMRYFGKSIRATAEERYIDXTNGXXTSNFRQLGKRSIXQTETLARQPLIFDXYAAYEPKKXLIFRAEVKNLFDRRYIDPLDAGNDAATQRYYSSFDPKDKDEEVTCNDDNTLCNGKYGGTSKSVLTNFARGXTFLITMSYKF

SEQ ID NO: 881 - DNA, 8 bp, Neisseria gonorrhoeae
  misc_feature (1)..(8): N = Unknown
nnnnnnnn

SEQ ID NO: 882 - protein, 922 aa, Neisseria gonorrhoeae
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLLNLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 883 - DNA, 2769 bp, Neisseria gonorrhoeae
atgagatcttctttccggttgaagccgatttgtttttatcttatgggtgttatgctatatcatcatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatgtgttcaaatccggcgaaaacctcgacaacatcgtacgcagcatacccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcgtctgtcggtgtgctttacgggcacagcaggcgcggcgtggcgcaaaattaccgcgtgggcggcggcgggcagcacatcggaaattttggtgaagaatatctggaacggcgcaaacagcaatattttgtacaagagggtggtttgaaattcaatgccggcagcggaaaatgggaacgggatttgcaaaggcaatactggaaaacaaagtggtataaaaaatacgaagacccccaagaactgcaaaaatacatcgaagagcatgataaaagctggcgggaaaacctggcgccgcaatacgacatcacccccatcgatccgtccggcctgaagcagcagtcggcaggcaatctgtttaaattggaatacgacggcgtattcaataaatacacggcgcaatttcgcgatttaaacaccagaatcggcagccgcaaaatcatcaaccgcaattatcaattcaattacggtttgtctttgaacccgtataccaacctcaatctgaccgcagcctacaattcgggcaggcagaaatatccgaaaggggcgaagtttacaggctgggggcttttaaaagattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgttgcctcaaaaatcaaccattgtccaaccggccggcagccaatatttcaacacgttctacttcgatgccgcgctcaaaaaagacatttaccgcttaaactacagcaccaatgcaatcaactaccgtttcggcggcgaatatacgggctattacggctcggaaaacgaatttaagcgggcattcggagaaaactcgccggcatacaaggaacattgcgacccgagctgcgggctttatgaacccgtattgaaaaaatacggcaaaaagcgcgccaacaaccattcggtcagcattagtgcggacttcggcgattatttcatgccgttcgccggctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatatattaggattgaaactggtcggctaccgcagccgcattgacaactacatccacaacgtttacgggaaatggtgggatttgaacggggatattccgagctgggtcggcagcaccgggcttgcctacaccatccgacaccgcaatttcaaagacaaagtgcacaaacacggttttgagctggagctgaattacgattatgggcgttttttcaccaacctttcttacgcctatcaaaaaagcacgcaaccgaccaatttcagcgatgcgagcgaatcgcccaacaatgcctccaaagaagaccaactcaaacaaggttatgggctgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatgtccggcaactgggcaagcgttccatcaaacaaaccgaaacccttgcccgacagcctttgatttttgatttttacgccgcttacgagccgaagaaaaaccttattttccgcgccgaagtcaaaaacctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaatttcgcacgcggacgcaccttcttgatgacgatgagctacaagttttaa

SEQ ID NO: 884 - protein, 922 aa, Neisseria gonorrhoeae
MRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLFKLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 885 - DNA, 498 bp, Neisseria meningitidis
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcgtgatcaatgtgcgcgaaatgttgcccgaccat

SEQ ID NO: 886 - protein, 166 aa, Neisseria meningitidis
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSVINVREMLPDH

SEQ ID NO: 887 - DNA, 980 bp, Neisseria meningitidis
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcrtkatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtstcggattgctgttccaccttgccggacggctctttgggtttaccagccaactcgg

SEQ ID NO: 888 - protein, 326 aa, Neisseria meningitidis
  misc_feature (156)..(156): Xaa= any amino acid
  misc_feature (309)..(309): Xaa= any amino acid
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSXINVREMLPDHTLLGIKIWARNDKNELAEAVEADSAVLNSDGSWQLKNIRRSTLGEDKVEVSIAAEENWPISVKRNLMDVLLVKPDQMSVGELTTYIRHLQNNSQNTRIYAIAWWRKLVYPAAAWVMALVAFAFTPQTTRHGNMGLKLFGGICXGLLFHLAGRLFGFTSQL

SEQ ID NO: 889 - DNA, 1071 bp, Neisseria meningitidis
  misc_feature (148)..(148): Xaa= any amino acid
  misc_feature (153)..(153): Xaa= any amino acid
  misc_feature (172)..(172): Xaa= any amino acid
  misc_feature (229)..(229): Xaa= any amino acid
  misc_feature (260)..(260): Xaa= any amino acid
  misc_feature (669)..(669): Xaa= any amino acid
  misc_feature (770)..(772): Xaa= any amino acid
  misc_feature (907)..(907): Xaa= any amino acid
  misc_feature (951)..(951): Xaa= any amino acid
  misc_feature (961)..(961): Xaa= any amino acid
  misc_feature (1001)..(1001): Xaa= any amino acid
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgntgggntacaccgccctcaaaatgnccgcccgcgcctacgaactgatgcccctcgccgtccttatcggcggactggtctctntcagccagcttgccgccggcagcgaactgancgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgcggccatcaacggcaaaatcagtaccggcaataccggcctttggctgaaagaaaaaaacagcattatcaatgtgcgcgaaatgttgcccgaccataccctgctgggcattaaaatctgggcccgcaacgataaaaacgaactggcagaggcagtggaagccgattccgccgttttgaacagcgacggcagttggcagttgaaaaacatccgccgcagcacgcttggcgaagacaaagtcgaggtctctattgcggctgaagaaaantggccgatttccgtcaaacgcaacctgatggacgtattgctcgtcaaacccgaccaaatgtccgtcggcgaactgaccacctacatccgccacctccaaannnacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaantcttcggcggcatctgtctcggattgctgttccaccttgccggncggctcttcnggtttaccagccaactctacggcatcccgcccttcctcgncggcgcactacctaccatagccttcgccttgctcgccgtttggctgatacgcaaacaggaaaaacgctaa

SEQ ID NO: 890 - protein, 356 aa, Neisseria meningitidis
  misc_feature (50)..(50): Xaa= any amino acid
  misc_feature (58)..(58): Xaa= any amino acid
  misc_feature (77)..(77): Xaa= any amino acid
  misc_feature (87)..(87): Xaa= any amino acid
  misc_feature (223)..(223): Xaa= any amino acid
  misc_feature (257)..(258): Xaa= any amino acid
  misc_feature (303)..(303): Xaa= any amino acid
  misc_feature (321)..(321): Xaa= any amino acid
  misc_feature (334)..(334): Xaa= any amino acid
MNLISRYIIRQMAVMAVYALLAFLALYSFFEILYETGNLGKGSYGIWEMXGYTALKMXARAYELMPLAVLIGGLVSXSQLAAGSELXVIKASGMSTKKLLLILSQFGFIFAIATVALGEWVAPTLSQKAENIKAAAINGKISTGNTGLWLKEKNSIINVREMLPDHTLLGIKIWARNDKNELAEAVEADSAVLNSDGSWQLKNIRRSTLGEDKVEVSIAAEEXWPISVKRNLMDVLLVKPDQMSVGELTTYIRHLQXXSQNTRIYAIAWWRKLVYPAAAWVMALVAFAFTPQTTRHGNMGLKXFGGICLGLLFHLAGRLFXFTSQLYGIPPFLXGALPTIAFALLAVWLIRKQEKR

SEQ ID NO: 891 - DNA, 1071 bp, Neisseria gonorrhoeae
atgaacctgatttcacgttacatcatccgccaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactcatgcccctcgccgtcctcatcggcggactggcctctctcagccagcttgccgccggcagcgaactggccgtcatcaaagccagcggcatgagcaccaaaaagctgctgttgattctgtctcagttcggttttatttttgctattgccgccgtcgcgctcggcgaatgggttgcgcccacgctgagccaaaaagccgaaaacatcaaagccgccgccattaacggcaaaatcagcaccggcaataccggcctttggctgaaagaaaaaaccagcattatcaatgtgcgcggaatgttgcccgaccatacgcttttgggcatcaaaatttgggcgcgcaacgataaaaacgaattggcagaggcagtggaagccgattccgccgttttgaacagcgacggcagctggcagttgaaaaacatccgccgcagcatcatgggtacagacaaaatcgaaacatccgccgccgccgaagaaacttggccgattgccgtcagacgcaacctgatggacgtattgctcgtcaagcccgaccaaatgtccgtcggcgagctgaccacctacatccgccacctccaaaacaacagccaaaacacccaaatctacgccatcgcatggtggcgtaaactcgtttaccccgtcgccgcatgggtcatggcgctcgttgccttcgcctttacgccgcaaaccacgcgccacggcaatatgggcttaaaactcttcggcggcatctgtctcggattgctgttccaccttgccggcaggctcttcgggtttaccagccaactctacggcaccccacccttcctcgccggcgcactgcctaccatagccttcgccttgctcgctgtttggctgatacgcaaacaggaaaaacgttga

SEQ ID NO: 892 - protein, 356 aa, Neisseria gonorrhoeae
MNLISRYIIRQMAVMAVYALLAFLALYSFFEILYETGNLGKGSYGIWEMLGYTALKMPARAYELMPLAVLIGGLASLSQLAAGSELAVIKASGMSTKKLLLILSQFGFIFAIAAVALGEWVAPTLSQKAENIKAAAINGKISTGNTGLWLKEKTSIINVRGMLPDHTLLGIKIWARNDKNELAEAVEADSAVLNSDGSWQLKNIRRSIMGTDKIETSAAAEETWPIAVRRNLMDVLLVKPDQMSVGELTTYIRHLQNNSQNTQIYAIAWWRKLVYPVAAWVMALVAFAFTPQTTRHGNMGLKLFGGICLGLLFHLAGRLFGFTSQLYGTPPFLAGALPTIAFALLAVWLIRKQEKR

SEQ ID NO: 893 - protein, 287 aa, Neisseria meningitidis; identical to SEQ ID NO: 218

SEQ ID NO: 894 - protein, 287 aa, Neisseria meningitidis; identical to SEQ ID NO: 218

SEQ ID NO: 895 - protein, 287 aa, Neisseria meningitidis; identical to SEQ ID NO: 218

SEQ ID NO: 896 - protein, 287 aa, Neisseria meningitidis; identical to SEQ ID NO: 218

SEQ ID NO: 897 - protein, 287 aa, Neisseria meningitidis; identical to SEQ ID NO: 218

SEQ ID NO: 898 - protein, 287 aa, Neisseria meningitidis
MKTFFKTLSAAALALILAACGGQKDSAPAASASAAADNGAEKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 899 - protein, 287 aa, Neisseria meningitidis; identical to SEQ ID NO: 898

SEQ ID NO: 900 - protein, 287 aa, Neisseria meningitidis
MKTFFKTLSAAALALILAACGGQKDSAPAASASAAADNGAEKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 901 - protein, 287 aa, Neisseria meningitidis; identical to SEQ ID NO: 900

SEQ ID NO: 902 - protein, 287 aa, Neisseria meningitidis; identical to SEQ ID NO: 900

SEQ ID NO: 903 - protein, 287 aa, Neisseria meningitidis
MKTFFKTLSAAALALILAACGGQKDSAPAASASAAADNGAAKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 904 - protein, 287 aa, Neisseria meningitidis; identical to SEQ ID NO: 903

SEQ ID NO: 905 - protein, 287 aa, Neisseria meningitidis; identical to SEQ ID NO: 903

SEQ ID NO: 906 - protein, 287 aa, Neisseria meningitidis; identical to SEQ ID NO: 222

SEQ ID NO: 907 - protein, 287 aa, Neisseria meningitidis; identical to SEQ ID NO: 903

SEQ ID NO: 908 - protein, 287 aa, Neisseria meningitidis; identical to SEQ ID NO: 903

SEQ ID NO: 909 - protein, 287 aa, Neisseria meningitidis; identical to SEQ ID NO: 900

SEQ ID NO: 910 - protein, 287 aa, Neisseria meningitidis; identical to SEQ ID NO: 900

SEQ ID NO: 911 - protein, 287 aa, Neisseria meningitidis; identical to SEQ ID NO: 900

SEQ ID NO: 912 - protein, 287 aa, Neisseria meningitidis; identical to SEQ ID NO: 900

SEQ ID NO: 913 - protein, 287 aa, Neisseria meningitidis; identical to SEQ ID NO: 218

SEQ ID NO: 914 - protein, 287 aa, Neisseria meningitidis
MKTFFKTLSAAALALILAACGGQKDSAPAASASAAADNGAAKKEIVFGTTVGDFGDLVKEQIQPELEKKGYTVELVEFTDYVRPNLALGEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 915 - protein, 287 aa, Neisseria meningitidis; identical to SEQ ID NO: 900

SEQ ID NO: 916 - protein, 287 aa, Neisseria meningitidis; identical to SEQ ID NO: 900

SEQ ID NO: 917 - protein, 287 aa, Neisseria meningitidis; identical to SEQ ID NO: 900

SEQ ID NO: 918 - protein, 287 aa, Neisseria meningitidis; identical to SEQ ID NO: 222

SEQ ID NO: 919 - protein, 287 aa, Neisseria meningitidis; identical to SEQ ID NO: 222

SEQ ID NO: 920 - protein, 287 aa, Neisseria meningitidis; identical to SEQ ID NO: 222

SEQ ID NO: 921 - protein, 288 aa, Neisseria gonorrhoeae; identical to SEQ ID NO: 226

SEQ ID NO: 922 - protein, 288 aa, Neisseria gonorrhoeae; identical to SEQ ID NO: 226

SEQ ID NO: 923 - protein, 287 aa, Neisseria meningitidis; identical to SEQ ID NO: 222

SEQ ID NO: 924 - DNA, 32 bp, Artificial Sequence
  Description of Artificial Sequence:  Novel Sequence
cgcggatccgctagcggacacacttatttcgg

SEQ ID NO: 925 - DNA, 27 bp, Artificial Sequence
  Description of Artificial Sequence:  Novel Sequence
cccgctcgagccagcggtagcctaatt

SEQ ID NO: 926 - DNA, 31 bp, Artificial Sequence
  Description of Artificial Sequence:  Novel Sequence
gcggatcccatatgtttgatttcggtttggg

SEQ ID NO: 927 - DNA, 25 bp, Artificial Sequence
  Description of Artificial Sequence:  Novel Sequence
cccgctcgaggacggcataacggcg

SEQ ID NO: 928 - DNA, 31 bp, Artificial Sequence; identical to SEQ ID NO: 926
  Description of Artificial Sequence:  Novel Sequence

SEQ ID NO: 929 - DNA, 27 bp, Artificial Sequence
  Description of Artificial Sequence:  Novel Sequence
cccgctcgagtgatttacggacgcgca

SEQ ID NO: 930 - DNA, 32 bp, Artificial Sequence
  Description of Artificial Sequence:  Novel Sequence
gcggatcccatatgtgcggaggtcaaaaagac

SEQ ID NO: 931 - DNA, 25 bp, Artificial Sequence
  Description of Artificial Sequence:  Novel Sequence
cccgctcgagtttggctgcgccttc

SEQ ID NO: 932 - DNA, 36 bp, Artificial Sequence
  Description of Artificial Sequence:  Novel Sequence
ggaattccatatggccatggtggaaggcgcacaacc

SEQ ID NO: 933 - DNA, 24 bp, Artificial Sequence
  Description of Artificial Sequence:  Novel Sequence
cgggatccatggaaggcgcacaac

SEQ ID NO: 934 - DNA, 26 bp, Artificial Sequence
  Description of Artificial Sequence:  Novel Sequence
cccgctcgaggactgtgcaaaaacgg

SEQ ID NO: 935 - DNA, 32 bp, Artificial Sequence
  Description of Artificial Sequence:  Novel Sequence
cgcggatcccatatgacccgtcaatctctgca

SEQ ID NO: 936 - DNA, 26 bp, Artificial Sequence
  Description of Artificial Sequence:  Novel Sequence
cccgctcgagtgcgccgaacactttc

SEQ ID NO: 937 - DNA, 32 bp, Artificial Sequence
  Description of Artificial Sequence:  Novel Sequence
cgcggatccgctagcgcgctgctttttgttcc

SEQ ID NO: 938 - DNA, 30 bp, Artificial Sequence
  Description of Artificial Sequence:  Novel Sequence
cccgctcgagtttcaaaatatatttgcgga

SEQ ID NO: 939 - DNA, 31 bp, Artificial Sequence
  Description of Artificial Sequence:  Novel Sequence
gcggatcccatatggctcaactgcttcgtac

SEQ ID NO: 940 - DNA, 25 bp, Artificial Sequence
  Description of Artificial Sequence:  Novel Sequence
cccgctcgagagcaggctttggcgc

SEQ ID NO: 941 - DNA, 32 bp, Artificial Sequence
  Description of Artificial Sequence:  Novel Sequence
cgcggatcccatatgccgaaggaagtcggaaa

SEQ ID NO: 942 - DNA, 27 bp, Artificial Sequence
  Description of Artificial Sequence:  Novel Sequence
cccgctcgagtttccgaggttttcggg

SEQ ID NO: 943 - DNA, 32 bp, Artificial Sequence
  Description of Artificial Sequence:  Novel Sequence
gcggatcccatatggacacaaaagaaatcctc

SEQ ID NO: 944 - DNA, 29 bp, Artificial Sequence
  Description of Artificial Sequence:  Novel Sequence
cccgctcgagtaatgggaaaccttgtttt

SEQ ID NO: 945 - DNA, 30 bp, Artificial Sequence
  Description of Artificial Sequence:  Novel Sequence
gcggatcccatatggcggtcaacctctacg

SEQ ID NO: 946 - DNA, 25 bp, Artificial Sequence
  Description of Artificial Sequence:  Novel Sequence
cccgctcgagggaaacgacttcgcc

SEQ ID NO: 947 - DNA, 31 bp, Artificial Sequence
  Description of Artificial Sequence:  Novel Sequence
cgcggatcccatatggctctgctttccgcgc

SEQ ID NO: 948 - DNA, 28 bp, Artificial Sequence
  Description of Artificial Sequence:  Novel Sequence
cccgctcgagagggtgtgtgataataag

SEQ ID NO: 949 - DNA, 35 bp, Artificial Sequence
  Description of Artificial Sequence:  Novel Sequence
ggaattccatatggccatgggcgggacactgacag

SEQ ID NO: 950 - DNA, 25 bp, Artificial Sequence
  Description of Artificial Sequence:  Novel Sequence
cgggatcctgcgggacactgacagg

SEQ ID NO: 951 - DNA, 28 bp, Artificial Sequence
  Description of Artificial Sequence:  Novel Sequence
cccgctcgagaggttggccttgtctatg

SEQ ID NO: 952 - DNA, 35 bp, Artificial Sequence
  Description of Artificial Sequence:  Novel Sequence
ggaattccatatggccatggttgccggcctgttcg

SEQ ID NO: 953 - DNA, 24 bp, Artificial Sequence
  Description of Artificial Sequence:  Novel Sequence
cgggatccattgccggcctgttcg

SEQ ID NO: 954 - DNA, 26 bp, Artificial Sequence
  Description of Artificial Sequence:  Novel Sequence
cccgctcgagaagcaggttgtacagc

SEQ ID NO: 955 - DNA, 32 bp, Artificial Sequence
  Description of Artificial Sequence:  Novel Sequence
gcggatcccatatgattttgctgcatttggat

SEQ ID NO: 956 - DNA, 29 bp, Artificial Sequence
  Description of Artificial Sequence:  Novel Sequence
cccgctcgagtcttccaatttctgaaagc

SEQ ID NO: 957 - DNA, 37 bp, Artificial Sequence
  Description of Artificial Sequence:  Novel Sequence
ggaattccatatggccatggtcgccagtgtttttacc

SEQ ID NO: 958 - DNA, 27 bp, Artificial Sequence
  Description of Artificial Sequence:  Novel Sequence
cgggatccttcgccagtgtttttaccg

SEQ ID NO: 959 - DNA, 28 bp, Artificial Sequence
  Description of Artificial Sequence:  Novel Sequence
cccgctcgagggtgtttttgaagctgcc

SEQ ID NO: 960 - DNA, 34 bp, Artificial Sequence
  Description of Artificial Sequence:  Novel Sequence
ggaattccatatggccatggtcggcgcgggtatg

SEQ ID NO: 961 - DNA, 23 bp, Artificial Sequence
  Description of Artificial Sequence:  Novel Sequence
cgggatccttcggcgcgggtatg

SEQ ID NO: 962 - DNA, 25 bp, Artificial Sequence
  Description of Artificial Sequence:  Novel Sequence
cccgctcgagcggcgagcgagagca

SEQ ID NO: 963 - DNA, 42 bp, Artificial Sequence
  Description of Artificial Sequence:  Novel Sequence
ggaattccatatggccatggtgattaaaatcaaaaaaggtct

SEQ ID NO: 964 - DNA, 36 bp, Artificial Sequence
  Description of Artificial Sequence:  Novel Sequence
cgggatccatgattaaaatcaaaaaaggtctaaacc

SEQ ID NO: 965 - DNA, 26 bp, Artificial Sequence
  Description of Artificial Sequence:  Novel Sequence
cccgctcgagattatgatagcggccc

SEQ ID NO: 966 - DNA, 33 bp, Artificial Sequence
  Description of Artificial Sequence:  Novel Sequence
cgcggatcccatatggatgtttctgtttcagac

SEQ ID NO: 967 - DNA, 30 bp, Artificial Sequence
  Description of Artificial Sequence:  Novel Sequence
cccgctcgagtttaaaccgataggtaaacg

SEQ ID NO: 968 - DNA, 37 bp, Artificial Sequence
  Description of Artificial Sequence:  Novel Sequence
ggaattccatatggccatggtgatgccggaaatggtg

SEQ ID NO: 969 - DNA, 26 bp, Artificial Sequence
  Description of Artificial Sequence:  Novel Sequence
cgggatccatgatgccggaaatggtg

SEQ ID NO: 970 - DNA, 25 bp, Artificial Sequence
  Description of Artificial Sequence:  Novel Sequence
cccgctcgagtgtcagcgtggcgca

SEQ ID NO: 971 - DNA, 31 bp, Artificial Sequence
  Description of Artificial Sequence:  Novel Sequence
gcggatcccatatgtatcgcaaactgattgc

SEQ ID NO: 972 - DNA, 26 bp, Artificial Sequence
  Description of Artificial Sequence:  Novel Sequence
cccgctcgagatcgatggaatagccg

SEQ ID NO: 973 - DNA, 31 bp, Artificial Sequence
  Description of Artificial Sequence:  Novel Sequence
gcggatcccatatgcagctgatcgactattc

SEQ ID NO: 974 - DNA, 26 bp, Artificial Sequence
  Description of Artificial Sequence:  Novel Sequence
cccgctcgaggacatcggcgcgtttt

SEQ ID NO: 975 - DNA, 33 bp, Artificial Sequence
  Description of Artificial Sequence:  Novel Sequence
cgggatcccagacctattctgtttattttaatc

SEQ ID NO: 976 - DNA, 30 bp, Artificial Sequence
  Description of Artificial Sequence:  Novel Sequence
cccgctcgaggggttcgattaaataaccat

SEQ ID NO: 977 - DNA, 38 bp, Artificial Sequence
  Description of Artificial Sequence:  Novel Sequence
ggaattccatatggccatggacggctgtacgttgatgt

SEQ ID NO: 978 - DNA, 26 bp, Artificial Sequence
  Description of Artificial Sequence:  Novel Sequence
cgggatccaacggctgtacgttgatg

SEQ ID NO: 979 - DNA, 29 bp, Artificial Sequence
  Description of Artificial Sequence:  Novel Sequence
cccgctcgagtttgtcagaggaattcgcg

SEQ ID NO: 980 - DNA, 31 bp, Artificial Sequence
  Description of Artificial Sequence:  Novel Sequence
gcggatcccatatgaacggtttggatgcccg

SEQ ID NO: 981 - DNA, 32 bp, Artificial Sequence
  Description of Artificial Sequence:  Novel Sequence
cgcggatccgctagcaacggtttggatgcccg

SEQ ID NO: 982 - DNA, 31 bp, Artificial Sequence
  Description of Artificial Sequence:  Novel Sequence
cccgctcgagtttgtctaagttcctgatatg

SEQ ID NO: 983 - DNA, 31 bp, Artificial Sequence
  Description of Artificial Sequence:  Novel Sequence
cgcggatcccatatgaatactcctccttttg

SEQ ID NO: 984 - DNA, 30 bp, Artificial Sequence
  Description of Artificial Sequence:  Novel Sequence
cccgctcgaggcgtattttttgatgctttg

SEQ ID NO: 985 - DNA, 32 bp, Artificial Sequence
  Description of Artificial Sequence:  Novel Sequence
gcggatcccatatgattgatagggatcgtatg

SEQ ID NO: 986 - DNA, 28 bp, Artificial Sequence
  Description of Artificial Sequence:  Novel Sequence
cccgctcgagttgatctttcaaacggcc

SEQ ID NO: 987 - DNA, 29 bp, Artificial Sequence
  Description of Artificial Sequence:  Novel Sequence
gcggatcccatatgttcagagctcagctt

SEQ ID NO: 988 - DNA, 30 bp, Artificial Sequence
  Description of Artificial Sequence:  Novel Sequence
cgcggatccgctagcttcagagctcagctt

SEQ ID NO: 989 - DNA, 28 bp, Artificial Sequence
  Description of Artificial Sequence:  Novel Sequence
cccgctcgagaaacagccatttgagcga

SEQ ID NO: 990 - DNA, 32 bp, Artificial Sequence
  Description of Artificial Sequence:  Novel Sequence
gcggatcccatatggatgacgtatcggatttt

SEQ ID NO: 991 - DNA, 26 bp, Artificial Sequence
  Description of Artificial Sequence:  Novel Sequence
cccgctcgagatagcccgctttcagg

SEQ ID NO: 992 - DNA, 32 bp, Artificial Sequence
  Description of Artificial Sequence:  Novel Sequence
cgcggatccgctagctccgaacgcgagtggat

SEQ ID NO: 993 - DNA, 28 bp, Artificial Sequence
  Description of Artificial Sequence:  Novel Sequence
cccgctcgagagcattgtccaaggggac

SEQ ID NO: 994 - DNA, 38 bp, Artificial Sequence
  Description of Artificial Sequence:  Novel Sequence
ggaattccatatggccatggtgctgtatctgaatcaag

SEQ ID NO: 995 - DNA, 28 bp, Artificial Sequence
  Description of Artificial Sequence:  Novel Sequence
cgggatccttgctgtatctgaatcaagg

SEQ ID NO: 996 - DNA, 25 bp, Artificial Sequence
  Description of Artificial Sequence:  Novel Sequence
cccgctcgagccgcatcggcagaca

SEQ ID NO: 997 - DNA, 30 bp, Artificial Sequence
  Description of Artificial Sequence:  Novel Sequence
gcggatcccatatgtacgcatttaccgccg

SEQ ID NO: 998 - DNA, 28 bp, Artificial Sequence
  Description of Artificial Sequence:  Novel Sequence
cccgctcgagtggattttgcagagatgg

SEQ ID NO: 999 - DNA, 35 bp, Artificial Sequence
  Description of Artificial Sequence:  Novel Sequence
cgcggatcccatatgaatgcagtaaaaatatctga

SEQ ID NO: 1000 - DNA, 27 bp, Artificial Sequence
  Description of Artificial Sequence:  Novel Sequence
cccgctcgaggcctgagacctttgcaa

SEQ ID NO: 1001 - DNA, 31 bp, Artificial Sequence
  Description of Artificial Sequence:  Novel Sequence
gcggatcccatatgagatttttcggtatcgg

SEQ ID NO: 1002 - DNA, 29 bp, Artificial Sequence
  Description of Artificial Sequence:  Novel Sequence
cccgctcgagttcatctttttcatgttcg

SEQ ID NO: 1003 - DNA, 31 bp, Artificial Sequence
  Description of Artificial Sequence:  Novel Sequence
gcggatcccatatgtctgtctttcaaacggc

SEQ ID NO: 1004 - DNA, 28 bp, Artificial Sequence
  Description of Artificial Sequence:  Novel Sequence
cccgctcgagtttgtttttgcaagacag

SEQ ID NO: 1005 - DNA, 34 bp, Artificial Sequence
  Description of Artificial Sequence:  Novel Sequence
gatcagctagccatatgaaacagaaaaaaaccgc

SEQ ID NO: 1006 - DNA, 26 bp, Artificial Sequence
  Description of Artificial Sequence:  Novel Sequence
cgggatccttacggtttgacaccgtt

SEQ ID NO: 1007 - DNA, 28 bp, Artificial Sequence
  Description of Artificial Sequence:  Novel Sequence
cgcggatcccatatggtttccgccgccg

SEQ ID NO: 1008 - DNA, 21 bp, Artificial Sequence
  Description of Artificial Sequence:  Novel Sequence
cccgctcgaggtgctgatgcg

SEQ ID NO: 1009 - DNA, 30 bp, Artificial Sequence
  Description of Artificial Sequence:  Novel Sequence
gcggatcccatatgaaaaccctgctgctgc

SEQ ID NO: 1010 - DNA, 24 bp, Artificial Sequence
  Description of Artificial Sequence:  Novel Sequence
cccgctcgaggccgcctttgcggc

SEQ ID NO: 1011 - DNA, 29 bp, Artificial Sequence
  Description of Artificial Sequence:  Novel Sequence
gcggatcccatatggcagagatctgtttg

SEQ ID NO: 1012 - DNA, 27 bp, Artificial Sequence
  Description of Artificial Sequence:  Novel Sequence
cccgctcgaggtttgccgatccgacca

SEQ ID NO: 1013 - DNA, 30 bp, Artificial Sequence
  Description of Artificial Sequence:  Novel Sequence
cgcggatcccatatggcggtttggggcgga

SEQ ID NO: 1014 - DNA, 24 bp, Artificial Sequence
  Description of Artificial Sequence:  Novel Sequence
cccgctcgagtcggcgcggcgggc

SEQ ID NO: 1015 - DNA, 36 bp, Artificial Sequence
  Description of Artificial Sequence:  Novel Sequence
ggaattccatatggccatggccataccttcttatca

SEQ ID NO: 1016 - DNA, 28 bp, Artificial Sequence
  Description of Artificial Sequence:  Novel Sequence
cgggatccgccataccttcttatcagag

SEQ ID NO: 1017 - DNA, 31 bp, Artificial Sequence
  Description of Artificial Sequence:  Novel Sequence
cccgctcgagttttttgcgattagaaaaagc

SEQ ID NO: 1018 - DNA, 30 bp, Artificial Sequence
  Description of Artificial Sequence:  Novel Sequence
gcggatcccatatgcatcctgccagcgaac

SEQ ID NO: 1019 - DNA, 28 bp, Artificial Sequence
  Description of Artificial Sequence:  Novel Sequence
cccgctcgagttcgcctacggttttttg

SEQ ID NO: 1020 - DNA, 27 bp, Artificial Sequence
  Description of Artificial Sequence:  Novel Sequence
gcggatcccatatgacggtaactgcgg

SEQ ID NO: 1021 - DNA, 28 bp, Artificial Sequence
  Description of Artificial Sequence:  Novel Sequence
cccgctcgagttgttgttcgggcaaatc

SEQ ID NO: 1022 - DNA, 30 bp, Artificial Sequence
  Description of Artificial Sequence:  Novel Sequence
gcggatcccatatgtcgggcatttacaccg

SEQ ID NO: 1023 - DNA, 26 bp, Artificial Sequence
  Description of Artificial Sequence:  Novel Sequence
cccgctcgagacgggtttcggcggaa

SEQ ID NO: 1024 - DNA, 32 bp, Artificial Sequence
  Description of Artificial Sequence:  Novel Sequence
gcggatcccatatgatttatcaaagaaacctc

SEQ ID NO: 1025 - DNA, 28 bp, Artificial Sequence
  Description of Artificial Sequence:  Novel Sequence
cccgctcgagttttccgcctttcaatgt

SEQ ID NO: 1026 - DNA, 30 bp, Artificial Sequence
  Description of Artificial Sequence:  Novel Sequence
gcggatcccatatggcagggctgttttacc

SEQ ID NO: 1027 - DNA, 28 bp, Artificial Sequence
  Description of Artificial Sequence:  Novel Sequence
cccgctcgagaaacggtttgaacacgac

SEQ ID NO: 1028 - DNA, 28 bp, Artificial Sequence
  Description of Artificial Sequence:  Novel Sequence
gcggatcccatatgaaccacgacatcac

SEQ ID NO: 1029 - DNA, 25 bp, Artificial Sequence
  Description of Artificial Sequence:  Novel Sequence
cccgctcgagcagccacaggacggc

SEQ ID NO: 1030 - DNA, 27 bp, Artificial Sequence
  Description of Artificial Sequence:  Novel Sequence
gcggatcccatatgacgtggggaacgc

SEQ ID NO: 1031 - DNA, 26 bp, Artificial Sequence
  Description of Artificial Sequence:  Novel Sequence
cccgctcgaggcggcgtttgaacggc

SEQ ID NO: 1032 - DNA, 33 bp, Artificial Sequence
  Description of Artificial Sequence:  Novel Sequence
gcggatcccatatgaccaaatttcaaacccctc

SEQ ID NO: 1033 - DNA, 28 bp, Artificial Sequence
  Description of Artificial Sequence:  Novel Sequence
cccgctcgagtaaacgaatgccgtccag

SEQ ID NO: 1034 - DNA, 30 bp, Artificial Sequence
  Description of Artificial Sequence:  Novel Sequence
gcggatcccatatgaggataaccgacggcg

SEQ ID NO: 1035 - DNA, 28 bp, Artificial Sequence
  Description of Artificial Sequence:  Novel Sequence
cccgctcgagtttgttcccgatgatgtt

SEQ ID NO: 1036 - DNA, 36 bp, Artificial Sequence
  Description of Artificial Sequence:  Novel Sequence
gcggatcccatatggaagatttatatataatactcg

SEQ ID NO: 1037 - DNA, 28 bp, Artificial Sequence
  Description of Artificial Sequence:  Novel Sequence
cccgctcgagatcagcttcgaaccgaag

SEQ ID NO: 1038 - DNA, 33 bp, Artificial Sequence
  Description of Artificial Sequence:  Novel Sequence
aaagaattcatgagtaaatcccgtagatctccc

SEQ ID NO: 1039 - DNA, 33 bp, Artificial Sequence
  Description of Artificial Sequence:  Novel Sequence
aaactgcagggaaaaccacatccgcactctgcc

SEQ ID NO: 1040 - DNA, 33 bp, Artificial Sequence
  Description of Artificial Sequence:  Novel Sequence
aaagaattcgcaccgcaaaaggcaaaaaccgca

SEQ ID NO: 1041 - DNA, 33 bp, Artificial Sequence
  Description of Artificial Sequence:  Novel Sequence
aaactgcagtctgcgcgttttcgggcagggtgg

SEQ ID NO: 1042 - DNA, 44 bp, Artificial Sequence
  Description of Artificial Sequence:  Novel Sequence
aaagaattcatgaacaaaaccctctatcgtgtgattttcaaccg

SEQ ID NO: 1043 - DNA, 39 bp, Artificial Sequence
  Description of Artificial Sequence:  Novel Sequence
aaactgcagttacgaatgcctgcttgctcgaccgtactg

SEQ ID NO: 1044 - DNA, 35 bp, Artificial Sequence
  Description of Artificial Sequence:  Novel Sequence
aaagaattcttgcttgtgcaaacagaaaaagacgg

SEQ ID NO: 1045 - DNA, 51 bp, Artificial Sequence
  Description of Artificial Sequence:  Novel Sequence
aaaaaagtcgacctattttttaggggcttttgcttgtttgaaaagcctgcc

SEQ ID NO: 1046 - DNA, 38 bp, Artificial Sequence
  Description of Artificial Sequence:  Novel Sequence
aaagaattctacaacatgtatcaggaaaaccaataccg

SEQ ID NO: 1047 - DNA, 39 bp, Artificial Sequence
  Description of Artificial Sequence:  Novel Sequence
aaactgcagttatgaaaacaggcgcagggcggttttgcc

SEQ ID NO: 1048 - DNA, 33 bp, Artificial Sequence
  Description of Artificial Sequence:  Novel Sequence
aaagaattcgcaaggctaccccaatccgccgtg

SEQ ID NO: 1049 - DNA, 33 bp, Artificial Sequence
  Description of Artificial Sequence:  Novel Sequence
aaactgcagcggtttggctgcctggccgttgat

SEQ ID NO: 1050 - DNA, 32 bp, Artificial Sequence
  Description of Artificial Sequence:  Novel Sequence
aaagaattcgccttggtctggctggttttcgc

SEQ ID NO: 1051 - DNA, 39 bp, Artificial Sequence
  Description of Artificial Sequence:  Novel Sequence
aaactgcagtcatccgccaccccacctcggccatccatc

SEQ ID NO: 1052 - DNA, 38 bp, Artificial Sequence
  Description of Artificial Sequence:  Novel Sequence
aaaaaagtcgacatgtcttaccgcgcaagcagttctcc

SEQ ID NO: 1053 - DNA, 42 bp, Artificial Sequence
  Description of Artificial Sequence:  Novel Sequence
aaactgcagtcaggaacacaaacgatgacgaatatccgtatc

SEQ ID NO: 1054 - DNA, 33 bp, Artificial Sequence
  Description of Artificial Sequence:  Novel Sequence
aaagaattcgcgctgttttttgcggcggcgtat

SEQ ID NO: 1055 - DNA, 33 bp, Artificial Sequence
  Description of Artificial Sequence:  Novel Sequence
aaactgcagcgccgtttcaagacgaaaaagtcg

SEQ ID NO: 1056 - DNA, 25 bp, Artificial Sequence
  Description of Artificial Sequence:  Novel Sequence
aaagaattcgcggaaacggtcgaag

SEQ ID NO: 1057 - DNA, 31 bp, Artificial Sequence
  Description of Artificial Sequence:  Novel Sequence
aaactgcagttaatcttgtcttccgatatac

SEQ ID NO: 1058 - DNA, 33 bp, Artificial Sequence
  Description of Artificial Sequence:  Novel Sequence
aaagaattcatgactgataatcgggggtttacg

SEQ ID NO: 1059 - DNA, 36 bp, Artificial Sequence
  Description of Artificial Sequence:  Novel Sequence
aaaaaagtcgaccttaagtaacttgcagtccttatc

SEQ ID NO: 1060 - DNA, 32 bp, Artificial Sequence
  Description of Artificial Sequence:  Novel Sequence
aaagaattcatgcaagctgtccgctacaggcc

SEQ ID NO: 1061 - DNA, 48 bp, Artificial Sequence
  Description of Artificial Sequence:  Novel Sequence
aaactgcagctattgcaatgcgccgccgcgggaatgtttgagcaggcg

SEQ ID NO: 1062 - DNA, 44 bp, Artificial Sequence
  Description of Artificial Sequence:  Novel Sequence
aaagaattcatggattttcgttttgacattatttacgaataccg

SEQ ID NO: 1063 - DNA, 36 bp, Artificial Sequence
  Description of Artificial Sequence:  Novel Sequence
aaactgcagttattttttgatgaaattttggggcgg

SEQ ID NO: 1064 - DNA, 33 bp, Artificial Sequence
  Description of Artificial Sequence:  Novel Sequence
aaagaattcgcagtacttgccattctcggtgcg

SEQ ID NO: 1065 - DNA, 33 bp, Artificial Sequence
  Description of Artificial Sequence:  Novel Sequence
aaactgcagctccggatcgtctgtaaacgcatt

SEQ ID NO: 1066 - DNA, 33 bp, Artificial Sequence
  Description of Artificial Sequence:  Novel Sequence
gcggatcccatatggaaattcgggcaataaaat

SEQ ID NO: 1067 - DNA, 25 bp, Artificial Sequence
  Description of Artificial Sequence:  Novel Sequence
cccgctcgagccagcggacgcgttc

SEQ ID NO: 1068 - DNA, 30 bp, Artificial Sequence
  Description of Artificial Sequence:  Novel Sequence
gcggatcccatatgaaagaagcggggtttg

SEQ ID NO: 1069 - DNA, 26 bp, Artificial Sequence
  Description of Artificial Sequence:  Novel Sequence
cccgctcgagccaatctgccagccgt

SEQ ID NO: 1070 - DNA, 31 bp, Artificial Sequence
  Description of Artificial Sequence:  Novel Sequence
cgcggatcccatatggaagatgcagggcgcg

SEQ ID NO: 1071 - DNA, 28 bp, Artificial Sequence
  Description of Artificial Sequence:  Novel Sequence
cccgctcgagaaacttgtagctcatcgt

SEQ ID NO: 1072 - DNA, 32 bp, Artificial Sequence
  Description of Artificial Sequence:  Novel Sequence
gcggatcccatatgtctgtgcaagcagtattg

SEQ ID NO: 1073 - DNA, 26 bp, Artificial Sequence
  Description of Artificial Sequence:  Novel Sequence
cccgctcgagatcctgtgccaatgcg

SEQ ID NO: 1074 - DNA, 31 bp, Artificial Sequence
  Description of Artificial Sequence:  Novel Sequence
gcggatcccatatgccgtctgaaaaagcttt

SEQ ID NO: 1075 - DNA, 27 bp, Artificial Sequence
  Description of Artificial Sequence:  Novel Sequence
cccgctcgagaaataccgctgaggatg

SEQ ID NO: 1076 - DNA, 33 bp, Artificial Sequence
  Description of Artificial Sequence:  Novel Sequence
cgcggatccgctagcatgaagcggcgtatagcc

SEQ ID NO: 1077 - DNA, 31 bp, Artificial Sequence
  Description of Artificial Sequence:  Novel Sequence
cccgctcgagttccgaatatttggaactttt

SEQ ID NO: 1078 - DNA, 31 bp, Artificial Sequence
  Description of Artificial Sequence:  Novel Sequence
cgcggatcccatatgggcacggcgggaaata

SEQ ID NO: 1079 - DNA, 26 bp, Artificial Sequence
  Description of Artificial Sequence:  Novel Sequence
cccgctcgagataacggtatgccgcc

SEQ ID NO: 1080 - DNA, 33 bp, Artificial Sequence
  Description of Artificial Sequence:  Novel Sequence
gcggatcccatatgtttcgtttacaattcaggc

SEQ ID NO: 1081 - DNA, 26 bp, Artificial Sequence
  Description of Artificial Sequence:  Novel Sequence
cccgctcgagcggcgttttatagcgg

SEQ ID NO: 1082 - DNA, 32 bp, Artificial Sequence
  Description of Artificial Sequence:  Novel Sequence
gcggatcccatatggcttttttggcggtaatg

SEQ ID NO: 1083 - DNA, 28 bp, Artificial Sequence
  Description of Artificial Sequence:  Novel Sequence
cccgctcgagtaacgtttccgtgcgttt

SEQ ID NO: 1084 - DNA, 29 bp, Artificial Sequence
  Description of Artificial Sequence:  Novel Sequence
gcggatcccatatgttgcccacaggcagc

SEQ ID NO: 1085 - DNA, 26 bp, Artificial Sequence
  Description of Artificial Sequence:  Novel Sequence
cccgctcgaggacgatggcaaacagc

SEQ ID NO: 1086 - DNA, 30 bp, Artificial Sequence
  Description of Artificial Sequence:  Novel Sequence
gcggatcccatatgccgtctgaagcagtct

SEQ ID NO: 1087 - DNA, 31 bp, Artificial Sequence
  Description of Artificial Sequence:  Novel Sequence
cccgctcgagatctgttgtttttaaaatatt

SEQ ID NO: 1088 - DNA, 33 bp, Artificial Sequence
  Description of Artificial Sequence:  Novel Sequence
gcggatcccatatggataattctggtagtgaag

SEQ ID NO: 1089 - DNA, 27 bp, Artificial Sequence
  Description of Artificial Sequence:  Novel Sequence
cccgctcgagaaacgtatagcctacct

SEQ ID NO: 1090 - DNA, 31 bp, Artificial Sequence
  Description of Artificial Sequence:  Novel Sequence
gcggatcccatatggataccgctttgaacct

SEQ ID NO: 1091 - DNA, 28 bp, Artificial Sequence
  Description of Artificial Sequence:  Novel Sequence
cccgctcgagaatggcttccgcaatatg

SEQ ID NO: 1092 - DNA, 33 bp, Artificial Sequence
  Description of Artificial Sequence:  Novel Sequence
gcggatcccatatgacctttttacaacgtttgc

SEQ ID NO: 1093 - DNA, 30 bp, Artificial Sequence
  Description of Artificial Sequence:  Novel Sequence
cccgctcgagagattgttgttgttttttcg

SEQ ID NO: 1094 - DNA, 31 bp, Artificial Sequence; identical to SEQ ID NO: 1003
  Description of Artificial Sequence:  Novel Sequence

SEQ ID NO: 1095 - DNA, 28 bp, Artificial Sequence
  Description of Artificial Sequence:  Novel Sequence
cccgctcgagtttgtttttgcaagacag

SEQ ID NO: 1096 - protein, 228 aa, Neisseria gonorrhoeae
MYALTAAQQQKALFRLVLFHILIIAASNYLVQFPFRIFGIHTTWGAFSFPFIFLATDLTVRIFGSHLARRIIFWVMFPALLLSYVFSVLFHNGSWTGLGALSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 1097 - protein, 287 aa, Neisseria meningitidis; identical to SEQ ID NO: 898

SEQ ID NO: 1098 - DNA, 36 bp, Artificial Sequence
  Novel Sequence
ggaattccatatggccatggagacctattctgttta

SEQ ID NO: 1099 - DNA, 15 bp, Artificial Sequence
  synthetic oligonucleotide primer
cgcggatcccatatg

SEQ ID NO: 1100 - DNA, 15 bp, Artificial Sequence
  synthetic oligonucleotide primer
cgcggatccgctagc

SEQ ID NO: 1101 - DNA, 17 bp, Artificial Sequence
  synthetic oligonucleotide primer
ccggaattctagctagc

SEQ ID NO: 1102 - DNA, 10 bp, Artificial Sequence
  synthetic oligonucleotide primer
cccgctcgag

SEQ ID NO: 1103 - DNA, 20 bp, Artificial Sequence
  synthetic oligonucleotide primer
ggaattccatatggccatgg

SEQ ID NO: 1104 - DNA, 17 bp, Artificial Sequence
  synthetic oligonucleotide primer
gatcagctagccatatg

SEQ ID NO: 1105 - protein, 167 aa, Haemophilus influenzae
MRQTIKYEFWVGLFLLLGIGALVFLGLRVANVQGFAETKSYTVTATFDNIGGLKVRAPLKIGGVVIGRVSAITLDEKSYLPKVSIAINQEYNEIPENSSLSIKTSGLLGEQYIALTMGFDDGDTAMLKNGSQIQDTTSAMVLEDLIGQFLYGSKKSDGNEKSESTEQ

SEQ ID NO: 1106 - protein, 149 aa, Neisseria gonorrhoeae
  MISC_FEATURE (149)..(149): X = any amino acid
GAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAEX

SEQ ID NO: 1107 - protein, 287 aa, Neisseria meningitidis
MKTFFKTLSAAALALILAACGGQKDSAPAASASAAADNGAEKKEIVFGTTVGDFGDMVKEHIQPELEKKGYTVELVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 1108 - protein, 170 aa, Bacillus subtilis
IAVVRLKIGSPVFFKQVRPGLHGKPFTLYKFRTMTDERDSKGNLLPDEVRLTKTGRLIRKLSIDELPQLLNVLKGDLSLVGPRPLLMDYLPLYTEKQARRHEVKPGITGWAQINGRNAISWEKKFELDVWYVDNWSFFLDLKILCLTVRKVLVSEGIQQTNHVTAERFTG

SEQ ID NO: 1109 - protein, 170 aa, Bacillus subtilis; identical to SEQ ID NO: 1108

SEQ ID NO: 1110 - protein, 195 aa, Bacillus subtilis
LKRLFDLTAAIFLLCCTSVIILFTIAVVRLKIGSPVFFKQVRPGLHGKPFTLYKFRTMTDERDSKGNLLPDEVRLTKTGRLIRKLSIDELPQLLNVLKGDLSLVGPRPLLMDYLPLYTEKQARRHEVKPGITGWAQINGRNAISWEKKFELDVWYVDNWSFFLDLKILCLTVRKVLVSEGIQQTNHVTAERFTGS

SEQ ID NO: 1111 - protein, 299 aa, Haemophilus influenzae
MNDEQQNSNQSENTKKPFFQSLFGRFFQGELKNREELVEVIRDSEQNDLIDQNTREMIEGVMEIAELRVRDIMIPRSQIIFIEDQQDLNTCLNTIIESAHSRFPVIADADDRDNIVGILHAKDLLKFLREDAEVFDLSSLLRPVVIVPESKRVDRMLKDFRSERFHMAIVVDEFGAVSGLVTIEDILEQIVGDIEDEFDEEEIADIRQLSRHTYAVRALTDIDDFNAQFNTDFDDEEVDTIGGLIMQTFGYLPKRGEEIILKNLQFKVTSADSRRLIQLRVTVPDEHLAEMNNVDEKSE

SEQ ID NO: 1112 - protein, 229 aa, Escherichia coli
DTISNKKGFFSLLLSQLFHGEPKNRDELLALIRDSGQNDLIDEDTRDMLEGVMDIADQRVRDIMIPRSQMITLKRNQTLDECLDVIIESAHSRFPVISEDKDHIEGILMAKDLLPFMRSDAEAFSMDKVLRQAVVVPESKRVDRMLKEFRSQRYHMAIVIDEFGGVSGLVTIEDILELIVGEIEDEYDEEDDIDFRQLSRHTWTVRALASIEDFNEAFGTHFSDEEVDT

SEQ ID NO: 1113 - protein, 347 aa, Haemophilus influenzae
MKKFLIAILLLILILAGVASFSYYKMTEFVKTPVNVQADELLTIERGTTSSKLATLFEQEKLIADGKLLPYLLKLKPELNKIKAGTYSLENVKTVQDLLDLLNSGKEVQFNVKWIEGKTFKDWRKDLENAPHLVQTLKDKSNEEIFALLDLPDIGQNLELKNVEGWLYPDTYNYTPKSTDLELLKRSAERMKKALNKAWNERDEDLPLANPYEMLILASIVEKETGIANERAKVASVFINRLKAKMKLQTDPTVIYGMGENYNGNIRKKDLETKTPYNTYVIDGLPPTPIAMPSESSLQAVANPEKTDFYYFVADGSGGHKFTRNLNEHNKAVQEYLRWYRSQKNAK

SEQ ID NO: 1114 - protein, 340 aa, Escherichia coli
MKKVLLIILLLLVVLGIAAGVGVWKVRHLADSKLLIKEETIFTLKPGTGRLALGEQLYADKIINRPRVFQWLLRIEPDLSHFKAGTYRFTPQMTVREMLKLLESGKEAQFPLRLVEGMRLSDYLKQLREAPYIKHTLSDDKYATVAQALELENPEWIEGWFWPDTWMYTANTTDVALLKRAHKKMVKAVDSAWEGRADGLPYKDKNQLVTMASIIEKETAVASERDKVASVFINRLRIGMRLQTDPTVIYGMGERYNGKLSRADLETPTAYNTYTITGLPPGAIATPGADSLKAAAHPAKTPYLYFVADGKGGHTFNTNLASHNKSVQDYLKVLKEKNAQ

SEQ ID NO: 1115 - protein, 576 aa, Pseudomonas aeruginosa
MNKSLALLTVTLLLGGCQSLIHKTPDGTPPVEDTAVETKAKPEKYGSFSEDSLYSLLVAELAGQRNRFDIALSNYVVQAQKTRDPGVSERAFRIAEYLGADQEALDTSLLWARSAPDNLDAQRAAAIQLARAGRYEESMVYMEKVLNGQGDTHFDFLALSAAETDPDTRAGLLQSFDHLLKKYPNNGQLLFGKALLLQQDGRPDEALTLLEDNSASRHEVAPLLLRSRLLQSMKRSDEALPLLKAGIKEHPDDKRVRLAYARLLVEQNRLDDAKAEFAGLVQQFPDDDDDLRFSLALVCLEAQAWDEARIYLEELVERDSHVDAAHFNLGRLAEEQKDTARALDEYAQVGPGNDFLPAQLRQTDVLLKAGRVDEAAQRLDKARSEQPDYAIQLYLIEAEALSNNDQQEKAWQAIQEGLKQYPEDLNLLYTRSMLAEKRNDLAQMEKDLRFVIAREPDNAMALNALGYTLADRTTRYGEARELILKAHKLNPDDPAILDSMGWINYRQGKLADAERYLRQALQRYPDHEVAAHLGEVLWAQGRQGDARAIWREYLDKQPDSDVLRRTIKRLTGAETP

SEQ ID NO: 1116 - protein, 545 aa, Aquifex aeolicus
MRKWIVAFSLFSISFSNPYFDALMCAYLSDKPKIAQNYCLSALEKIPSPELYKDTIKVLLRNKEYEKAKELAKEFLETYPDEPQAYIYLYTIYKFLKEDKKAFEVIKEAYKSFPFNENVVLFLANEYINKGKLREAEKVLLEYMETDPDNPLPYYLLGRIYLAKGDIQKGMEYFLKALEKKKYYAPAVLSLGNLYLQEKKFKEAEELYKSVLEKYPNSPKILEKLAKLYTASGRIEEAIKIYEKLINLKPRNVNYKTEYALLLLSTGEFDKAKKILEELYYVNPSNPNVAFAYALTLEATGELKKAKEIYENLLNRFPENIKVIERLIGIYLDLGNYEDAKRLIEKAKVLAPDKKEILFLEADYYSKTKQYDKALEILKKLEKDYPNDSRVYFMEAIVYDNLGDIKNAEKALRKAIELDPENPDYYNYLGYSLLLWYGKERVEEAEELIKKALEKDPENPAYIDSMGWVYYLKGDYERAMQYLLKALREAYDDPVVNEHVGDVLLKMGYKEEARNYYERALKLLEEGKQGERGQKERLLKKLENL

SEQ ID NO: 1117 - protein, 560 aa, Pseudomonas putida
MDIKRTILIAALAVVSYVMVLKWNDDYGQAALPTQNTAASTVAPGLPDGVPAGNNGASADVPSANAESSPAELAPVALSKDLIRVKTDVLELAIDPVGGDIVQLNLPKYPRRQDHPNIPFQLFDNGGERVYLAQSGLTGTDGPDARASGRPLYAAEQKSYQLADGQEQLVVDLKFSDNGVNYIKRFSFKRGEYDLNVSYLIDNQSGQAWNGNMFAQLKRDASGDPSSSTATGTATYLGAALWTASEPYKKVSMKDIDKGSLKENVSGGWVAWLQHYFVTAWIPAKSDNNVVQTRKDSQGNYIIGYTGPVISVPAGGKVETSALLYAGPKIQSKLKELSPGLELTVDYGFLWFIAQPIFWLLQHIHSLLGNWGWSIIVLTMLIKGLFFPLSAASYRSMARMRAVAPKLAALKERFGDDRQKMSQAMMELYKKEKINPLGGCLPILVQMPVFLALYWVLLESVEMRQAPWILWITDLSIKDPFFILPIIMGATMFIQQRLNPTPPDPMQAKVMKMMPIIFTFFFLWFPAGLVLYWVVNNCLSISQQWYITRRIEAATKKAAA

SEQ ID NO: 1118 - protein, 171 aa, Escherichia coli
MFDIGFSELLLVFIIGLVVLGPQRLPVAVKTVAGWIRALRSLATTVQNELTQELKLQEFQDSLKKVEKASLTNLTPELKASMDELRQAAESMKRSYVANDPEKASDEAHTIHNPVVKDNETAHEGVTPAAAQTQASSPEQKPETTPEPVVKPAADAEPKTAAPSPSSSDKP

SEQ ID NO: 1119 - protein, 264 aa, Haemophilus influenzae
MFTFILLCLLVGALAGFLAGLFGIGGGLVIVPTLVYLLPIVDVPESLLMSTALGTSFATIVITGIGSAQRHHKLGNIVWQAVRILAPVIMLSVFICGLFIGRLDREISAKIFACLVVYLATKMVLSIKKDQVTTKSLTPLSSVIGGILIGMASSAAGIGGGGFIVPFLTARGINIKQAIGSSAFCGMLLGISGMFSFIVSGWGNPLMPEYSLGYIYLPAVLGITATSFFTSKLGASATAKLPVSTLKKGFALFLIVVAINMFLK

SEQ ID NO: 1120 - protein, 718 aa, Haemophilus influenzae
MNIRLNAKVISTIPVFIAVNIAAVGIWFFDISSQSMPLILGIIAGGLVDLDNRLTGRLKNVFFTLIAFSISSFIVQLHIGKPIQYIVLMTVLTFIFTMIGAVGQRYSTIAFGSLVVALYTTLTYIPEVNVWFINPVMILCGTLLYSVVTLIVYLFFPNRPVQESVAKAFCALGEYLDTKSCFFDPDEVAEIEKKHLNFAMKNANVVTAFNIVRTALFYRIRGQHRHPLTQRMLRYYFAAQDIHERANSTHFDYQQITEKLKNTDLIFRIQRLLELQAQSCKEITASLRENKPYHFNKRVERALLGTLHSFDLYRAQHLNDQDELIDIQTLLDNLQSINWQLRQLAQDTTVTEQLAQIHTEQITGLKNISAVIFSHFTFESPLFRHAVRLSIVVFLCCAIVEFFQFNLGYWILLTTVFVCQPNYSATKVRLRQRIIGTILGVVVGSLLPYLNPTLELKLGLVVLTSTLFFFFRSNNYSFSTFFITLQVLLSFDVMGFDTAAALMPRLLDTLLGAAISWFAVSYLWPDWKYLQLDKVSHQALRSDAVYLLHIISQLQFGKSDDLKYRIARRNAHQYAAALSTTLSNMNNEPVKYKAYLQKGFDLLKLNYSLLSYISALGAYRDRMKNLQQTAQFLSGFYPVAKKIIYTLEHIEEIPEAIFNQQQESIETHLKELEKQEMTAEERAVFSLPYQQLNLITQLLPQFYGYFKKEINCQSAGAL

SEQ ID NO: 1121 - protein, 417 aa, Neisseria gonorrhoeae
  misc_feature (14)..(14): Xaa can be any naturally occurring amino acid
RQSLRLLSDGNDSXDIRHLSRLLDNLGSVDQQFRQLRHSDSPAENDRMGDTRIAALETGSFKNTWQAIRPQLNLESGVFRHAVRLSLVVAAACTIVEALNLNLGYWILLTRLFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADTCNPALPCSKPATALTGYISALGHTAAKCTKNAAPTLPHSSTLPPNTPPTSSNTCPTWDPTTFRRHWIHCAANSAPSAPAAAEHKATSSSNSSNSSPGSSNPTTAPTDKFRTGSPKTQPEKISAFW

SEQ ID NO: 1122 - protein, 524 aa, Salmonella typhimurium
MQEFYARVWNTKEMNLLKSLAAVSSMTMFSRVLGFARDAIVARIFGAGMATDAFFVAFKLPNLLRRIFAEGAFSQAFVPILAEYKSKQGEEATRIFVAYVSGLLTLALAVVTVAGMLAAPWVIMVTAPGFADTADKFALTTQLLRITFPYILLISLASLVGAILNTWNRFSIPAFAPTFLNISMIGFALFAAPYFNPPVLALAWAVTVGGVLQLVYQLPYLKKIGMLVLPRINFRDTGAMRVVKQMGPAILGVSVSQISLIINTIFASFLASGSVSWMYYADRLMEFPSGVLGVALGTILLPSLSKSFASGNHDEYCRLMDWGLRLCFLLALPSAVALGILAKPLTVSLFQYGKFTAFDAAMTQRALIAYSVGLIGLIVVKVLAPGFYSRQDIKTPVKIAIVTLIMTQLMNLAFIGPLKHAGLSLSIGLAACLNASLLYWQLRKQNIFTPQPGWMWFLMRLIISVLVMAAVLFGVLHIMPEWSQGSMLWRLLRLMAVVIAGIAAYFAALAVLGFKVKEFVRRTA

SEQ ID NO: 1123 - protein, 449 aa, Actinobacillus pleuropneumoniae
MITIKKGLDLPIAGTPAQVIHNGNTVNEVAMLGEEYVGMRPSMKVREGDVVKKGQVLFEDKKNPGVVFTAPASGTVVTINRGEKRVLQSVVIKVEGDEQITFTRYEAAQLASLSAEQVKQNLIESGLWTAFRTRPFSKVPALDAIPSSIFVNAMDTNPLAADPEVVLKEYETDFKDGLTVLTRLFNGQKPVYLCKDADSNIPLSPAIEGITIKSFSGVHPAGLVGTHIHFVDPVGATKQVWHLNYQDVIAIGKLFTTGELFTDRIISLAGPQVKNPRLVRTRLGANLSQLTANELNAGENRVISGSVLSGATAAGPVDYLGRYALQVSVLAEGREKELFGWIMPGSDKFSITRTVLGHFGKKLFNFTTAVHGGERAMVPIGAYERVMPLDIIPTLLLRDLAAGDTDSAQNLGCLELDEEDLALCTYVCPGKNNYGPMLRAALEKIEKEG

SEQ ID NO: 1124 - protein, 510 aa, Escherichia coli
MPMSMSSIPSSSQSGKLYGWVERIGNKVPHPFLLFIYLIIVLMVTTAILSAFGVSAKNPTDGTPVVVKNLLSVEGLHWFLPNVIKNFSGFAPLGAILALVLGAGLAERVGLLPALMVKMASHVNARYASYMVLFIAFFSHISSDAALVIMPPMGALIFLAVGRHPVAGLLAAIAGVGCGFTANLLIVTTDVLLSGISTEAAAAFNPQMHVSVIDNWYFMASSVVVLTIVGGLITDKIIEPRLGQWQGNSDEKLQTLTESQRFGLRIAGVVSLLFIAAIALMVIPQNGILRDPINHTVMPSPFIKGIVPLIILFFFVVSLAYGIATRTIRRQADLPHLMIEPMKEMAGFIVMVFPLAQFVAMFNWSNMGKFIAVGLTDILESSGLSGIPAFVGLALLSSFLCMFIASGSAIWSILAPIFVPMFMLLGFHPAFAQILFRIADSSVLPLAPVSPFVPLFLGFLQRYKPDAKLGTYYSLVLPYPLIFLVVWLLMLLAWYLVGLPIGPGIYPRLS

SEQ ID NO: 1125 - protein, 259 aa, Erwinia chrysanthemi
MKAVKTSQRVMVWALVWLTGLQPVLPAWAAGVTVASGNTALEAAGNGVPVVNIATPDASGLSHNRYHDFNVDNRGLILNNGTARLTPSQLGGLIQNNPNLNGRAAAAILNEVVSPNRSRLAGYLEVAGQAANVVVANPYGITCSGCGFLNTPRLTLTTGTPQFDAAGGLSGLDVRGGDILIDGAGLDASRSDYFGLIARTASLQAGLNARDAQVVLGANRVGADGRVTAQAGSGPAPVLALDTGALGGMYANRIRLVST

SEQ ID NO: 1126 - protein, 276 aa, Pasteurella haemolytica
MNFKKLLGVALVSALALTACKDEKAQAPATTAKTENKAPLKVGVMTGPEAQMTEVAVKIAKEKYGLDVELVQFTEYTQPNAALHSKDLDANAFQTVPYLEQEVKDRGYKLAIIGNTLVWPIAAYSKKIKNISELKDGATVAIPNNASNTARALLLLQAHGLLKLKDPKNVFATENDIIENPKNIKIVQADTSLLTRMLDDVELAVINNTYAGQAGLSPDKDGIIVESKDSPYVNLVVSREDNKDDPRLQTFVKSFQTEEVFQEALKLFNGGVVKGW

SEQ ID NO: 1127 - protein, 267 aa, Bordetella pertussis
MIILIDSGNSRLKVGWFDPDAPQAAREPAPVAFDNLDLDALGRWLATLPRRPQRALGVNVAGLARGEAIAATLRAGGCDIRWLRAQPLAMGLRNGYRNPDQLGADRWACMVGVLARQPSVHPPLLVASFGTATTLDTIGPDNVFPGGLILPGPAMMRGALAYGTAHLPLADGLVADYPIDTHQAIASGIAAAQAGAIVRQWLAGRQRYGQAPEIYVAGGGWPEVRQEAERLLAVTGAAFGATPQPTYLDSPVLDGLAALAAQGAPTA

SEQ ID NO: 1128 - protein, 128 aa, Haemophilus influenzae
MLYQILALLIWSSSLIVGKLTYSMMDPVLVVQVRLIIAMIIVMPLFLRRWKKIDKPMRKQLWWLAFFNYTAVFLLQFIGLKYTSASSAVTMIGLEPLLVVFVGHFFFKTKQNGFTGYSVQWHLLAWQF

SEQ ID NO: 1129 - protein, 771 aa, Azorhizobium caulinodans
MTQAAFDQASDNGPMTPSGSSFGLFAPAVVLLALISALATFLILMGLTPVVPTHQVVISVLLVNAAAVLILSAMVGREIWRIAKARARGRAAARLHIRIVGLFAVVSVVPAILVAVVASLTLDRGLDRWFSMRTQEIVASSVSVAQTYVREHALNIRGDILAMSADLTRLKSVYEGDRSRFNQILTAQAALRNLPGAMLIRRDLSVVERANVNIGREFIVPANLAIGDATPDQPVIYLPNDADYVAAVVPLKDYDDLYLYVARLIDPRVIGYLKTTQETLADYRSLEERRFGVQVAFALMYAVITLIVLLSAVWLGLNFSKWLVAPIRRLMSAADHVAEGNLDVRVPIYRAEGDLASLAETFNKMTHELRSQREAILTARDQIDSRRRFTEAVLSGVGAGVIGLDSQERITILNRSAERLLGLSEVEALHRHLAEVVPETAGLLEEAEHARQRSVQGNITLTRDGRERVFAVRVTTEQSPEAEHGWVVTLDDITELISAQRTSAWADVARRIAHEIKNPLTPIQLSAERLKRKFGRHVTQDREIFDQCTDTIIRQVGDIGRMVDEFSSFARMPKPVVDSQDMSEIIRQTVFLMRVGHPEVVFDSEVPPAMPARFDRRLVSQALTNILKNAAEAIEAVPPDVRGQGRIRVSANRVGEDLVIDIIDNGTGLPQESRNRLLEPYVTTREKGTGLGLAIVGKIMEEHGGGIELNDAPEGRGAWIRLTLKAEGPKAEPTDASTKATGAATPAAPAASAMARDAAADSAARGKNERT

SEQ ID NO: 1130 - protein, 221 aa, Escherichia coli
MNVFSQTQRYKALFWLSLFHLLVITSSNYLVQLPVSILGFHTTWGAFSFPFIFLATDLTVRIFGAPLARRIIFAVMIPALLISYVISSLFYMGSWQGFGALAHFNLFVARIATASFMAYALGQILDVHVFNRLRQSRRWWLAPTASTLFGNVSDTLAFFFIAFWRSPDAFMAEHWMEIALVDYCFKVLISIVFFLPMYGVLLNMLLKRLADKSEINALQAS

SEQ ID NO: 1131 - protein, 286 aa, Escherichia coli
MKQHQSADNSQGQLYIVPTPIGNLADITQRALEVLQAVDLIAAEDTRHTGLLLQHFGINARLFALHDHNEQQKAETLLAKLQEGQNIALVSDAGTPLINDPGYHLVRTCREAGIRVVPLPGPCAAITALSAAGLPSDRFCYEGFLPAKSKGRRDALKAIEAEPRTLIFYESTHRLLDSLEDIVAVLGESRYVVLARELTKTWETIHGAPVGELLAWVKEDENRRKGEMVLIVEGHKAQEEDLPADALRTLALLQAELPLKKAAALAAEIHGVKKNALYKYALEQQG

SEQ ID NO: 1132 - protein, 292 aa, Bacillus subtilis
MKKIAIAAITATSILALSACSSGDKEVIAKTDAGDVTKGELYTNMKKTAGASVLTQLVQEKVLDKKYKVSDKEIDNKLKEYKTQLGDQYTALEKQYGKDYLKEQVKYELLTQKAAKDNIKVTDADIKEYWEGLKGKIRASHILVADKKTAEEVEKKLKKGEKFEDLAKEYSTDSSASKGGDLGWFAKEGQMDETFSKAAFKLKTGEVSDPVKTQYGYHIIKKTEERGKYDDMKKELKSEVLEQKLNDNAAVQEAVQKVMKKADIEVKDKDLKDTFNTSSTSNSTSSSSSNSK

SEQ ID NO: 1133 - protein, 547 aa, Escherichia coli
MNLDFWMTVFNKFARSFKSHWLLYLSVIVFGITNLVASSGAHMVQRLLFFVLTILVVKRISSLPLRLLVAAPFVLLTAADMSISLYSWCTFGTTFNDGFAISVLQSDPDEVAKMLGMYSPYLCAFAFLSLLFLAVIIKYDVSLPTKKVTGILLLIVISGSLFSACQFAYKDAKNKNAFSPYILASRFATYTPFFNLNYFALAAKEHQRLLSIANTVPYFQLSVRDTGIDTYVLIVGESVRVDNMSLYGYTRSTTPQVEAQRKQIKLFNQAISGAPYTALSVPLSLTADSVLSHDIHNYPDNIINMANQAGFQTFWLSSQSAFRQNGTAVTSIAMRAMETVYVRGFDELLLPHLSQALQQNTQQKKLIVLHLNGSHEPACSAYPQSSAVFQPQDDQDACYDNSIHYTDSLLGQVFELLKDRRASVMYFADHGLERDPTKKNVYFHGGREASQQAYHVPMFIWYSPVLGDGVDRTTENNIFSTAYNNYLINAWMGVTKPEQPQTLEEVIVHYKGDSLVVDANHDVFDYVMLRKEFTEDKQGNPTPEGQG

SEQ ID NO: 1134 - protein, 537 aa, Aquifex aeolicus
MKRVLEFLGGFGGLVFGFVFFVGMSILGLFHLEEHPPLYWAGFFASVFLFVLSFLLNLINWVKALIKDYKKHGSVLAFVYDFLASLKLAIFIMLVLGILSMLGSTYIKQNQSFEWYLDQFGYDVGIWIWKLWLNDVFHSWYYILFIVLLAVNLIFCSIKRLPRVWKQAFSKERILKLDEHAEKHLKPITVKIPDKDKVLKFLLKKGFKVFVEEEGNKLYVFAEKGRFSRLGVYITHIALLVIMAGALIDAIVGVRGSLIVAEGDTNDVMLVGAEQKPYKLPFAVHLIDFRIKTYAEENPNVDKRFAQAVSSYESDIEIINGGKVEAKGTVKVNEPFDFGRYRLFQATYGILDGTSGMGVIVVDRKKAHEDPEKAVIGTFEIKTGQVVEFKDMLISIDRVVLNVHDPNNRNELAPAVVLKVMLNRELYSVPVIYDPRLTALVFSQIPELKDFPYMFFMNGFEPLFFSGFEVSYHPGSVIIWIGSAILVLGMVVAFYTVHRKVWMRIEGDTAKVAFYSHKFKEEFKRSFLRELEELKRA

SEQ ID NO: 1135 - protein, 165 aa, Neisseria gonorrhoeae
MNTLQKGFTLIELMIVIAIVGILAAVALPAYQDYTARAQVSEAILLAEGQKSAVTEYYLNHGIWPKDNTSAGVASSDKIKGKYVQSVTVAKGVVTAEMASTGVNKEIQGKKLSLWAKRQDGSVKWFCGQPVTRGAKDDDAVTADGNNKIDTKHLPSTCRDNFDAS

SEQ ID NO: 1136 - protein, 211 aa, Escherichia coli [sequence omitted]

SEQ ID NO: 1137 - protein, 473 aa, Streptococcus thermophilus
MNKYKKLLSNSLVFTIGNLGSKLLVFLLVPLYTYAMTPQEYGMADLYQTTANLLLPLITMNVFDATLRFAMEKSMTKESVLTNSLVVWCFSAVFTCLGACIIYALNLSNKWYLALLLTFNLFQGGQSILSQYARGIGKSKIFAAGGVILTFLTGALNILFLVYLPLGITGYLMSLVLANVGTILFFAGTLSIWKEISFKIIDKKLIWQMLYYALPLIPSSILWWLLNASSRYFVLFFLGAGANGLLAVATKIPSIISIFNTIFTQAWQISAIEEYDSHQKSKYYSDVFHYLATFLLLGTSAFMIVLKPIVEKVVSSDYASSWQYVPFFMLSMLFSSFSDFFGTNYIAAKQTKGVFMTSIYGTIVCVLLQVVLLPIIGLDGAGLSAMLGFLTTFLLRVKDTQKFVVIQIKWRIFISNLLIVLAQILCLFYLPSEFLYFGLALLFCGMLVVNQRTILYIIMALKIKNKTFGMKSS

SEQ ID NO: 1138 - protein, 306 aa, Haemophilus influenzae
MKQQPLLGFTFALITAMAWGSLPIALKQVLSVMNAQTIVWYRFIIAAVSLLALLAYKKQLPELMKVRQYAWIMLIGVIGLTSNFLLFSSSLNYIEPSVAQIFIHLSSFGMLICGVLIFKEKLGLHQKIGLFLLLIGLGLFFNDRFDAFAGLNQYSTGVILGVGGALIWVAYGMAQKLMLRKFNSQQILLMMYLGCAIAFMPMADFSQVQELTPLALICFIYCCLNTLIGYGSYAEALNRWDVSKVSVVITLVPLFTILFSHIAHYFSPADFAAPELNNISYIGAFVVVCGAILSAIGHKLLPHKNH

SEQ ID NO: 1139 - protein, 569 aa, Schizosaccharomyces pombe
MAMSSITSAKQLNAEELLDECDSFNGEFVPGTIPFRANGAAIGYVTPLVLEILIKADNFKFNWVYVPGEYIEINASTFEKRTDILAKVLEHWRHNNTFGIADQWRNELYTVYGKSKKPVLAVERGGFWLFGFLSTGVHCTMYIPATKEHPLRIWVPRRSPTKQTWPNYLDNSVAGGIAHGDSVIGTMIKEFSEEANLDVSSMNLIPCGTVSYIKMEKRHWIQPELQYVFDLPVDDLVIPRINDGEVAGFSLLPLNQVLHELELKSFKPNCALVLLDFLIRHGIITPQHPQYLQTLERIHRPLPVPVGKYERGDSFEDTSKKAETCVPAKPQKATHQLAPCKAWLRDYDTDQKFAVLLLNQPIDIPDDRFRTLWKRASIRVCADGGANQLRNYDSSLKPDYVVGDFDSLTDETKAYYKEMGVNIVFDPCQNTTDFMKCHKIIKEHGIDTIFVLCGMGGRVDHAIGNLNHLFWAASISEKNEVFLLTELNVSTLLQPGINHVDCHDNIGLHCGLLPVGQSVYVKKTSGLEWNIEDRICQFGGLVSSCNVVTKATVTIEVNNFIVWTMETRL

SEQ ID NO: 1140 - protein, 261 aa, Pseudomonas denitrificans
MQDLAFHLLAFLFVAAFIAGFIDSIAGGGGMITIPAMLIAGIPPLQTLGTNKLQGLFGSGSATLSYARRGHVNLKEQLPMALMSAAGAVLGALLATIVPGDVLKAILPFLLIAIALYFGLKPNMGDVDQHSRVTPFVFTLTLVPLIGFYDGVFGPGTGSFFMLGFVTLAGFGVLKATAHTKFLNFGSNVGAFGVFLFFGAVLWKVGLLMGLGQFLGAQVGSRYAMAKGAKIIKPLLVIVSIALAIRLLADPTHPLRIWLGH

SEQ ID NO: 1141 - protein, 346 aa, Haemophilus influenzae
MKKLISGIIAVAMALSLAACQKETKVISLSGKTMGTTYHVKYLDDGSITATSEKTHEEIEAILKDVNAKMSTYKKDSELSRFNQNTQVNTPIEISADFAKVLAEAIRLNKVTEGALDVTVGPVVNLWGFGPEKRPEKQPTPEQLAERQAWVGIDKITLDTNKEKATLSKALPQVYVDLSSIAKGFGVDQVAEKLEQLNAQNYMVEIGGEIRAKGKNIEGKPWQIAIEKPTTTGERAVEAVIGLNNMGMASSGDYRIYFEENGKRFAHEIDPKTGYPIQHHLASITVLAPTSMTADGLSTGLFVLGEDKALEVAEKNNLAVYLIIRTDNGFVTKSSSAFKKLTETKE

SEQ ID NO: 1142 - protein, 1329 aa, Escherichia coli
MSQEYIEDKEVTLTKLSSGRRLLEALLILIVLFAVWLMAALLSFNPSDPSWSQTAWHEPIHNLGGMPGAWLADTLFFIFGVMAYTIPVIIVGGCWFAWRHQSSDEYIDYFAVSLRIIGVLALILTSCGLAAINADDIWYFASGGVIGSLLSTTLQPLLHSSGGTIALLCVWAAGLTLFTGWSWVTIAEKLGGWILNILTFASNRTRRDDTWVDEDEYEDDEEYEDENHGKQHESRRARILRGALARRKRLAEKFINPMGRQTDAALFSGKRMDDDEEITYTARGVAADPDDVLFSGNRATQPEYDEYDPLLNGAPITEPVAVAAAATTATQSWAAPVEPVTQTPPVASVDVPPAQPTVAWQPVPGPQTGEPVIAPAPEGYPQQSQYAQPAVQYNEPLQQPVQPQQPYYAPAAEQPAQQPYYAPAPEQPVAGNAWQAEEQQSTFAPQSTYQTEQTYQQPAAQEPLYQQPQPVEQQPVVEPEPVVEETKPARPPLYYFEEVEEKRAREREQLAAWYQPIPEPVKEPEPIKSSLKAPSVAAVPPVEAAAAVSPLASGVKKATLATGAAATVAAPVFSLANSGGPRPQVKEGIGPQLPRPKRIRVPTRRELASYGIKLPSQRAAEEKAREAQRNQYDSGDQYNDDEIDAMQQDELARQFAQTQQQRYGEQYQHDVPVNAEDADAAAEAELARQFAQTQQQRYSGEQPAGANPFSLDDFEFSPMKALLDDGPHEPLFTPIVEPVQQPQQPVAPQQQYQQPQQPVPPQPQYQQPQQPVAPQPQYQQPQQPVAPQQQYQQPQQPVAPQQQYQQPQQPVAPQPQDTLLHPLLMRNGDSRPLHKPTTPLPSLDLLTPPPSEVEPVDTFALEQMARLVEARLADFRIKADVVNYSPGPVITRFELNLAPGVKAARISNLSRDLARSLSTVAVRVVEVIPGKPYVGLELPNKKRQTVYLREVLDNAKFRDNPSPLTVVLGKDIAGEPVVADLAKMPHLLVAGTTGSGKSVGVNAMILSMLYKAQPEDVRFIMIDPKMLELSVYEGIPHLLTEVVTDMKDAANALRWCVNEMERRYKLMSALGVRNLAGYNEKIAEADRMMRPIPDPYWKPGDSMDAQHPVLKKEPYIVVLVDEFADLMMTVGKKVEELIARLAQKARAAGIHLVLATQRPSVDVITGLIKANIPTRIAFTVSSKIDSRTILDQAGAESLLGMGDMLYSGPNSTLPVRVHGAFVRDQEVHAVVQDWKARGRPQYVDGITSDSESEGGAGGFDGAEELDPLFDQAVQFVTEKRKASISGVQRQFRIGYNRAARIIEQMEAQGIVSEQGHNGNREVLAPPPFD

SEQ ID NO: 1143 - protein, 2273 aa, Neisseria meningitidis
MNKRCYKVIFNKKRSCMMAVAENVHRDGKSMQDSEAASVRVTGAASVSSARAAFGFRMAAFSVMLALGVAAFSPAPASGIIADKSAPKNQQAVILQTANGLPQVNIQTPSSQGVSVNRFKQFDVDEKGVILNNSRSNTQTQLGGWIQGNPHLARGEARVIVNQIDSSNPSLLNGYIEVGGKRAEVVVANPSGIRVNGGGLINAASVTLTSGVPVLNNGNLTGFDVSSGKVVIGGKGLDTSDADYTRILSRAAEINAGVWGKDVKVVSGKNKLDFDGSLAKTASAPSSSDSVTPTVAIDTATLGGMYADKITLISTDNGAVIRNKGRIFAATGGVTLSADGKLSNSGSIDAAEITISAQTVDNRQGFIRSGKGSVLKVSDGINNQAGLIGSAGLLDIRDTGKSSLHINNTDGTIIAGKDVSLQAKSLDNDGILTAARDVSVSLHDDFAGKRDIEAGRTLTFSTQGRLKNTRIIQAGDTVSLTAAQIDNTVSGKIQSGNRTGLNGKNGITNRGLINSNGITLLQTEAKSDNAGTGRIYGSRVAVEADTLLNREETVNGETKAAVIAARERLDIGAREIENREAALLSSSGDLHIGSALNGSRQVQGANTSLHNRSAAIESSGNIRIATKDLQNTNEHLRFHTEETHREHRIEYQAEGRTERYPEGSQKELGWEIFEDESLHMRTPDGSPHSVWYKYDYERITAESKITESKPGQIISGGNLVLDAAKLKNHNSRIIAGGRLIVGTPESALDNDETLGTKTITDKGDLHRYHRHHKKGRDSTGYSRSPYEPAPEVSSIRMGISAYKGYAPQQASDIPGTVVPVVAENGIHPTFTLPNSSLFAIAPNNKGYLIETDPAFTDYRKWLGSGYMLAALQQDPNHIHKRLGDGYYEQKLVNEQIAKLTGYRRLDGYTNDEEQFKALMDNGITIAKELQLTPGIALSAEQVARLTSDIVWLENETVTLPDGTTQTVLKPKVYVRARPKDMNGQGALLSGSVVDIGSGAIENRGGLIAGREALILNAQNIKNLQGDLQGKNIFAAAGSDITNTGSIGAENALLLKASNNIESRSETRSNQNEQGSVRNIGRVAGIYLTGRQNGSVLLDAGNNIVLTASELTNQSEDGQTVLNAGGDIRSDTTGISRNQNTIFDSDNYVIRKEQNEVGSTIRTRGNLSLNAKGDIRIRAAEVGSEQGRLKLAAGRDIKVEAGKAHTETEDALKYTGRSGGGIKQKMTRHLKNQNGQAVSGTLDGKEIILVSGRDITVTGSNIIADNHTILSAKNNIVLKAAETRSRSAEMNKKEKSGLMGSGGIGFTAGSKKDTQTNRSETVSHTESVVGSLNGNTLISAGKHYTQTGSTISSPQGDVGISSGKISIDAAQNRYSQESKQVYEQKGVTVAISVPVVNTVMGAVDAVKAVQTVGKSKNSRVNAMAAANALNKGVDSGVALYNAARNPKKAAGQGISVSVTYGEQKNTSESRIKGTQVQEGKITGGGKVSLTASGAGKDSRITITGSDVYGGKGTRLKAENAVQIEAARQTHQERSENKSAGFNAGVAIAINKGISFGFTAGANYGKGYGNGDETAYRNSHIGSKDSQTAIESGGDTVIKGGQLKGKGVGVTAESLHIESLQDTAVFKGKQENVSAQVTVGYGFSVGGSYNRSKSSSDYASVNEQSGIFAGGDGYRIRVNGKTGLVGAAVVSDADKSKNLLKTSEIWHKDIQNHASAAASALGLSGGFSYSPKPTSGQYSTKKEAEIGKIGGKPVSLMRFDQVSAKDDELNEKYRSERIEKGETFKEANLNQNNAGGLKFGLKQNDIHSNDKYALAKMGLGNLLGNAKESESRQSITRSVISEGDWQIASAQGRKNIAGIEKGTSSAHKALAKADREGLLKEVELNRDVAKEFINETLIGGIADEAYRSQFIAEHRLMTFKMDENGEPIEDKQLEEDINKQFDNSVKLKKEFASFKDYWEAYKAIGGNIYELREVSDQERKNLKTARYTDPETGKTVEKIVVGVNGIFNNIQAAAKFAAQQYVGRFNPEKNRYERTYENVYFLHNPETNGRGFSKLPEIAVAAFHKMLEGAKIGNKTVIGLSNSGLALGNIMEDYGKDKNGLFVGSHSRGTLVVDNVLNTLNTQANRDKKILSNTELKMVGPAANVVRADKRLFQLQQGVTTPRTADFARQSIQIENHELDLIGMLIGRNPATVGTNTRQKSQWQAIRDIIGDYTSPHNCYGMANKQCVTDGYRDPENKQTQSPTGVFERGVSNEIEIMYRPVRIYDLQHPKGKTK

SEQ ID NO: 1144 - protein, 648 aa, Escherichia coli
MTPLLELKDIRRSYPAGDEQVEVLKGISLDIYAGEMVAIVGASGSGKSTLMNILGCLDKATSGTYRVAGQDVATLDADALAQLRREHFGFIFQRYHLLSHLTAEQNVEVPAVYAGLERKQRLLRAQELLQRLGLEDRTEYYPAQLSGGQQQRVSIARALMNGGQVILADEPTGALDSHSGEEVMAILHQLRDRGHTVIIVTHDPQVAAQAERVIEIRDGEIVRNPPAIEKVNVTGGTEPVVNTVSGWRQFVSGFNEALTMAWRALAANKMRTLLTMLGIIIGIASVVSIVVVGDAAKQMVLADIRSIGTNTIDVYPGKDFGDDDPQYQQALKYDDLIAIQKQPWVASATPAVSQNLRLRYNNVDVAASANGVSGDYFNVYGMTFSEGNTFNQEQLNGRAQVVVLDSNTRRQLFPHKADVVGEVILVGNMPARVIGVAEEKQSMFGSSKVLRVWLPYSTMSGRVMGQSWLNSITVRVKEGFDSAEAEQQLTRLLSLRHGKKDFFTWNMDGVLKTVEKTTRTLQLFLTLVAVISLVVGGIGVMNIMLVSVTERTREIGIRMAVGARASDVLQQFLIEAVLVCLVGGALGITLSLLIAFTLQLFLPGWEIGFSPLALLLAFLCSTVTGILFGWLPARNAARLDPVDALARE

SEQ ID NO: 1145 - protein, 648 aa, Escherichia coli; identical to SEQ ID NO: 1144

SEQ ID NO: 1146 - protein, 261 aa, Neisseria meningitidis
KNSDIFDRTLPRKGLWLRVIDGHSNQWVQGKTAPVEGYRKGVQLGGEVFTWQNESNQLSIGLMGGQAEQRSTFHNPDTDNLTTGNVKGFGAGVYATWHQLQDKQTGAYADSWMQYQRFRHRINTEDGTERFTSKGITASIEAGYNALLAEHFTKKGNSLRVYLQPQAQLTYLGVNGKFSDSENAHVNLLGSRQLQTRVGVQAKAQFSLYKNIAIEPFAAVNALYHNKPFGVEMDGERRVINNKTAIESQLGVAVKIKSHLT

SEQ ID NO: 1147 - protein, 253 aa, Pseudomonas fluorescens
MDKLKGALLVGALRLFALLPWRAVQAVGSAIGWFMWKLPNRSRDVVRINLAKCFPEMDPAERERLVGQSLKDIGKSLTESACAWIWPAQRSIDLVREVEGLEVLKEALASGKGVVGITSHLGNWEVLNHFYCSQCKPIIFYRPPKLKAVDELLRKQRVQLGNKVAASTKEGILSVIKEVRKGGQVGIPADPEPAESAGIFVPFFATQALTSKFVPNMLAGGKAVGVFLHALRLPDGSGYKVILEAAPEAMYST

SEQ ID NO: 1148 - protein, 454 aa, Escherichia coli
MSTITLLCIALAGVIMLLLLVIKAKVQPFVALLLVSLLVALAAGIPAGEVGKVMIAGMGGVLGSVTIIIGLGAMLGRMIEHSGGAESLANYFSRKLGDKRTIAALTLAAFFLGIPVFFDVGFIILAPIIYGFAKVAKISPLKFGLPVAGIMLTVHVAVPPHPGPVAAAGLLHADIGWLTIIGIAISIPVGVVGYFAAKIINKRQYAMSVEVLEQMQLAPASEEGATKLSDKINPPGVALVTSLIVIPIAIIMAGTVSATLMPPSHPLLGTLQLIGSPMVALMIALVLAFWLLALRRGWSLQHTSDIMGSALPTAAVVILVTGAGGVFGKVLVESGVGKALANMLQMIDLPLLPAAFIISLALRASQGSATVAILTTGGLLSEAVMGLNPIQCVLVTLAACFGGLGASHINDSGFWIVTKYLGLSVADGLKTWTVLTTILGFTGFLITWCVWAVI

SEQ ID NO: 1149 - protein, 558 aa, Erwinia chrysanthemi
MPVSSRKTGLIACLSLIGYTASAFSASLNPAERSEIQQRQSEVIEQSRQQREALQQLNDIAQAPLKADNAPQGPCFTLRDIRFNHSTLLRPSDQATLVAGYLNRCNNLEQINQLVHDVSNWYIQRGYITSRAFLSEQDLSGGVLQLEILEGRLEKITINNQTERMTRTAFPAHEGEILNLRDIEQGMEQMNRMPSQQVTIEIQPGSQPGYSVVNLTREAHLPFSGGLTFDNSGQKSTGEEQLNGSLALDNVFGLADQWFISAGHSSRFATSHDAESLQAGFSMPYGYWNLGYNYSQSRYRNTFINRDFPWHSTGDSDTHRFSLSRVVFRDGTMKTAIAGTFSQRTGNNYLNGSLLPSSSRKLSSVSLGVNHSQKLWGGLATFNPTYNRGVRWLGSETDTDKSADEPRAEFNKWTLSASYYHPVTDSITYLGSLYGQYSARALYGSEQLTLGGESSIRGFREQYTSGNRGAYWRNELNWQAWQLPVLGNVTFMAAVDGGHLYNHKQDNSTAASLWGGAVGMTVASRWLSQQVTVGWPISYPAWLQPDTMVVGYRVGLSF

SEQ ID NO: 1150 - protein, 352 aa, Escherichia coli
MRADKSLSPFEIRVYRHYRIVHGTRVALAFLLTFLIIRLFTIPESTWPLVTMVVIMGPISFWGNVVPRAFERIGGTVLGSILGLIALQLELISLPLMLVWCAAAMFLCGWLALGKKPYQGLLIGVTLAIVVGSPTGEIDTALWRSGDVILGSLLAMLFTGIWPQRAFIHWRIQLAKSLTEYNRVYQSAFSPNLLERPRLESHLQKLLTDAVKMRGLIAPASKETRIPKSIYEGIQTINRNLVCMLELQINAYWATRPSHFVLLNAQKLRDTQHMMQQILLSLVHALYEGNPQPVFANTEKLNDAVEELRQLLNNHHDLKVVETPIYGYVWLNMETAHQLELLSNLICRALRK

SEQ ID NO: 1151 - protein, 286 aa, Escherichia coli; identical to SEQ ID NO: 1131

SEQ ID NO: 1152 - protein, 286 aa, Escherichia coli; identical to SEQ ID NO: 1131

SEQ ID NO: 1153 - protein, 1394 aa, Haemophilus influenzae
MKKTVFRLNFLTACISLGIVSQAWAGHTYFGIDYQYYRDFAENKGKFTVGAQNIKVYNKQGQLVGTSMTKAPMIDFSVVSRNGVAALVENQYIVSVAHNVGYTDVDFGAEGNNPDQHRFTYKIVKRNNYKKDNLHPYEDDYHNPRLHKFVTEAAPIDMTSNMNGSTYSDRTKYPERVRIGSGRQFWRNDQDKGDQVAGAYHYLTAGNTHNQRGAGNGYSYLGGDVRKAGEYGPLPIAGSKGDSGSPMFIYDAEKQKWLINGILREGNPFEGKENGFQLVRKSYFDEIFERDLHTSLYTRAGNGVYTISGNDNGQGSITQKSGIPSEIKITLANMSLPLKEKDKVHNPRYDGPNIYSPRLNNGETLYFMDQKQGSLIFASDINQGAGGLYFEGNFTVSPNSNQTWQGAGIHVSENSTVTWKVNGVEHDRLSKIGKGTLHVQAKGENKGSISVGDGKVILEQQADDQGNKQAFSEIGLVSGRGTVQLNDDKQFDTDKFYFGFRGGRLDLNGHSLTFKRIQNTDEGAMIVNHNTTQAANVTITGNESIVLPNGNNINKLDYRKEIAYNGWFGETDKNKHNGRLNLIYKPTTEDRTLLLSGGTNLKGDITQTKGKLFFSGRPTPHAYNHLNKRWSEMEGIPQGEIVWDHDWINRTFKAENFQIKGGSAVVSRNVSSIEGNWTVSNNANATFGVVPNQQNTICTRSDWTGLTTCQKVDLTDTKVINSIPKTQINGSINLTDNATANVKGLAKLNGNVTLTNHSQFTLSNNATQIGNIRLSDNSTATVDNANLNGNVHLTDSAQFSLKNSHFSHQIQGDKGTTVTLENATWTMPSDTTLQNLTLNNSTITLNSAYSASSNNTPRRRSLETETTPTSAEHRFNTLTVNGKLSGQGTFQFTSSLFGYKSDKLKLSNDAEGDYILSVRNTGKEPETLEQLTLVESKDNQPLSDKLKFTLENDHVDAGALRYKLVKNDGEFRLHNPIKEQELHNDLVRAEQAERTLEAKQVEPTAKTQTGEPKVRSRRAARAAFPDTLPDQSLLNALEAKQAELTAETQKSKAKTKKVRSKRAVFSDPLLDQSLFALEAALEVIDAPQQSEKDRLAQEEAEKQRKQKDLISRYSNSALSELSATVNSMLSVQDELDRLFVDQAQSAVWTNIAQDKRRYDSDAFRAYQQQKTNLRQIGVQKALANGRIGAVFSHSRSDNTFDEQVKNHATLTMMSGFAQYQWGDLQFGVNVGTGISASKMAEEQSRKIHRKAINYGVNASYQFRLGQLGIQPYFGVNRYFIERENYQSEEVRVKTPSLAFNRYNAGIRVDYTFTPTDNISVKPYFFVNYVDVSNANVQTTVNLTVLQQPFGRYWQKEVGLKAEILHFQISAFISKSQGSQLGKQQNVGVKLGYRW

SEQ ID NO: 1154 - protein, 809 aa, Pseudomonas putida
MNHTARKRQGWQRSVSQKLAGAVVQGIACMGASAPLLLMPAWATAAAQAQADFDIPAGPLAPALAHFGQSAHILLSYPTALTEGRSTSGLAGRFDIDQGLAILLAGTGLEASRGANASYSLQASASTGALELSAVSISGKAPGSTTEGTGLYTTYSSSSSTRLNLTPRETPQSLTVMTRQRLDDQRLTNLTDALEATPGITVVRDGLGSESDSYWSRGFAIQNYEVDGVPTSTRLDNYSQSMAMFDRVEIVRGATGLISGMGNPSATINLIRKRPTAEAQASITGEAGNWDRYGTGFDVSGPLTETGNIRGRFVADYKTEKAWIDRYNQQSQLMYGITEFDLSEDTLLTVGFSYLRSDIDSPLRSGLPTRFSTGERTNLKRSLNAAPDWSYNDHEQTSFFTSIEQQLGNGWSGKIELTHAENKFDELFNFAMGELNPDGSGLSQLPVRFSGTPRQDNLDLYATGPFSLFGREHELITGMTLSQYRENTPSWGGWRYDYAGSPAGAIDNLFNWDGKSAKPAFVESGKSSIDEDQYAAYLTSRFSVTDDLSLILGSRLINWKRDTSDRPYGGEETEVNREENGVFIPYAGVGYDLDDTWSLYASYTKIFNPQGAWVTDESNKPLDPMEGVGYELGIKGTHLNGKLNSSLAVFKLEQDNLAIWQHDNVYSAEQDTTSKGIELELNGELAEGWQASAGYSYSVTTDADDQRINTNLPRNSFKTFTSYRLHGPLDKITIGGGVNWQSKVGADLHTFSQGSYAVTNLMARYDINQHLSASVNLNNVFDREYYSQSGLYGVYGTPRNVMTSFKYSF

SEQ ID NO: 1155 - protein, 729 aa, Escherichia coli
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 1156 - protein, 519 aa, Haemophilus influenzae
MLSVLSINYRYYLMELIDFSSSVWSIVPALLAIILAIATRRVLVSLSAGIIIGSLMLSDWQIGSAFNYLVKNVVSLVYADGEINSNMNIVLFLLLLGVLTALLTVSGSNRAFAEWAQSRIKGRRGAKLLAASLVFVTFIDDYFHSLAVGAIARPVTDRFKVSRAKLAYILDSTAAPMCVMMPVSSWGAYIITLIGGLLATYSITEYTPIGAFVAMSSMNFYAIFSIIMVFFVAYFSFDIASMVRHEKLALKNTEDQLEEETGTKGQVRNLILPILVLIIATVSMMIYTGAEALAADGKVFSVLGTFENTVVGTSLVVGGFCSIIISTLLIILDRQVSVPEYVRSWIVGIKSMSGAIAILFFAWTINKIVGDMQTGKYLSSLVSGNIPMQFLPVILFVLGAAMAFSTGTSWGTFGIMLPIAAAMAANAAPELLLPCLSAVMAGAVCGDHCSPVSDTTILSSTGAKCNHIDHVTTQLPYAATVATATSIGYIVVGFTYSGLAGFAATAVSLIVIIFAVKKR

SEQ ID NO: 1157 - protein, 396 aa, Pseudomonas stutzeri
MQVIDRRKALSIAPIWRLAFRPFFLAGSLYALLAIPLWVAAWTGLWPGFQPTGGWLAWHRHEMLFGFAMAIVAGFLLTAVQTWTGQTAPSGNRLVGLAAVWLAARLGWLFGLPAAWLAPLDLLFLVALVWMMAQMLWAVRQKRNYPIVVVLSLMLGADVLILTGLLQGNDALQRQGVLAGLWLVAALMALIGGRVIPFFTQRGLGKVDAVKPWVWLDVALLVGTGVIALLHAFGVAMRPQPLLGLLFVAIGVGHLLRLMRWYDKGIWKVGLLWSLHVAMLWLVVAAFGLALWHFGLLAQSSPSLHALSVGSMSGLILAMIARVTLGHTGRPLQLPAGIIGAFVLFNLGTAARVFLSVAWPVGGLWLAAVCWTLAFALYVWRYAPMLVAARVDGHPG

SEQ ID NO: 1158 - protein, 212 aa, Haemophilus influenzae
MNQFFITSINIIKKQEQMEFLIGFFTEYGYWAVLFVLIICGFGVPIPEDITLVSGGVIAGLYPENVNSHLMLLVSMIGVLAGDSCMYWLGRIYGTKILRFRPIRRIVTLQRLRMVREKFSQYGNRVLFVARFLPGLRAPIYMVSGITRRVSYVRFVLIDFCAAIISVPIWIYLGELGAKNLDWLHTQIQKGQIVIYIFIGYLYYSFLEMEKI

SEQ ID NO: 1159 - protein, 151 aa, Aquifex aeolicus
MLNIMRKLLTLIVVFVALSFGAPKIVVKHPWVMEPPPGPNTTMMGMIIVNEGDEPDYLIGAKTDIAQRVELHKTVIENDVAKMVPQERIEIPPKGKVEFKHHGYHVMIIGLKKRIKEGDKVKVELIFEKSGKITVEAPVVKKHRMKHHMHH

SEQ ID NO: 1160 - protein, 148 aa, Helicobacter pylori
MGFLNGYFLWVKAFHVIAVISWMAALFYLPRLFVYHAENAHKKEFVGVVQIQEKKLYSFIASPAMGFTLITGILMLLIEPTLFKSGGWLHAKLALVVLLLAYHFYCKKCMRELEKDPTRRNARFYRVFNEAPTILMILIVILVVVKPF

SEQ ID NO: 1161 - protein, 380 aa, Escherichia coli
MAYGVFRKFMKKRKTVKKRYVIALVIVIAGLITLWRILNAPVPTYQTLIVRPGDLQQSVLATGKLDALRKVDVGAQVSGQLKTLSVAIGDKVKKDQLLGVIDPEQAENQIKEVEATLMELRAQRQQAEAELKLARVTYSRQQRLAQTKAVSQQDLDTAATEMAVKQAQIGTIDAQIKRNQASLDTAKTNLDYTRIVAPMAGEVTQITTLQGQTVIAAQQAPNILTLADMSAMLVKAQVSEADVIHLKPGQKAWFTVLGDPLTRYEGQIKDVLPTPEKVNDAIFYYARFEVPNPNGLLRLDMTAQVHIQLTDVKNVLTIPLSALGDPVGDNRYKVKLLRNGETREREVTIGARNDTDVEIVKGLEAGDEVVIGEAKPGAAQ

SEQ ID NO: 1162 - protein, 349 aa, Haemophilus influenzae
  misc_feature (201)..(201): Xaa can be any naturally occurring amino acid
MLEMLKSWYSRRLSDPQAMGLLAILLFGFISIYFFGDLIAPLLIALVLSYLLEIPINFLNQYLKCPRMLATILIFGSFIGLAAVFFLVLVPMLWNQTISLLSDLPAMFNKSNEWLLNLPKNYPELIDYSMVDSIFNSVREKILGFGESAVKLSLASIMNLVSLGIYAFLVPLMMFFMLKDKSELLQGVSRFLPKNRNLAFXRWKEMQQQISNYIHGKLLEILIVTLITYIIFLIFGLNYPLLLAFAVGLSVLVPYIGAVIVTIPVALVALFQFGISPTFWYIIIAFAVSQLLDGNLLVPYLFSEAVNLHPLIIIISVLIFGGLWGFWGVFFAIPLATLVKAVINALPQD

SEQ ID NO: 1163 - protein, 327 aa, Rhizobium etli
MRILVNGAGVAGLTVAWQLYRHGFRVTLAERAGTVGAGASGFAGGMLAPWCERESAEEPVLTLGRLAADWWEAALPGHVHRRGTLVVAGGRDTGELDRFSRRTSGWEWLDEVAIAALEPDLAGRFRRALFFRQEAHLDPRQALAALAAGLEDARMRLTLGVVGESDVDHDRVVDCTGAAQIGRLPGLRGVRGEMLCVETTEVSLSRPVRLLHPRHPIYIVPRDKNRFMVGATMIESDDGGPITARSLMELLNAAYAMHPAFGEARVTETGAGVRPAYPDNLPRVTQEGRTLHVNGLYRHGFLLAPAMAGEVARRLLTEQGQPERRAS

SEQ ID NO: 1164 - protein, 245 aa, Haemophilus influenzae
MDIFFVISGFLITGIIITEIQQNSFSLKQFYTRRIKRIYPAFITVMALVSFIASAIFIYNDFNKLRKTIELAIAFLSNFYLGLTQGYFDLSANENPVLHIWSLAVEGQYYLIFPLILILAYKKFREVKVLFIITLILFFILLATSFVSANFYKEVLHQPNIYYLSNLRFPELLVGSLLAIYHNLSNKVQLSKQVNNILAILSTLLLFSCLFLMNNNIAFIPGITLILPCIFTALIIHTTSQNNIR

SEQ ID NO: 1165 - protein, 224 aa, Archaeoglobus fulgidus
MAAINQFDIDLFIRILPDLAFGASVTLKLTLISIFFGLIIGTIAGLGRVSKNPLPFAISTAYVEVIRGTPLLVQILIVYFGLPAIGINLQPEPAGIIALSICSGAYIAEIVRAGIESIPIGQMEAARSLGMTYLQAMRYVIFPQAFRNILPALGNEFIALLKDSSLLSVISIVELTRVGRQIVNTTFNAWTPFLGVALFYLMMTIPLSRLVAYSQKKLGTYQVK

SEQ ID NO: 1166 - protein, 457 aa, Escherichia coli
MRIHILGICGTFMGGLAMLARQLGHEVTGSDANVYPPMSTLLEKQGIELIQGYDASQLEPQPDLVIIGNAMTRGNPCVEAVLEKNIPYMSGPQWLHDFVLRDRWVLAVAGTHGKTTTAGMATWILEQCGYKPGFVIGGVPGNFEVSAHLGESDFFVIEADEYDCAFFDKRSKFVHYCPRTLILNNLEFDHADIFDDLKAIQKQFHHLVRIVPGQGRIIWPENDINLKQTMAMGCWSEQELVGEQGHWQAKKLTTDASEWEVLLDGEKVGEVKWSLVGEHNMHNGLMAIAAARHVGVAPADAANALGSFINARRRLELRGEANGVTVYDDFAHHPTAILATLAALRGKVGGTARIIAVLEPRSNTMKMGICKDDLAPSLGRADEVFLLQPAHIPWQVAEVAEACVQPAHWSGDVDTLADMVVKTAQPGDHILVMSNGGFGGIHQKLLDGLAKKAEAAQ

SEQ ID NO: 1167 - protein, 913 aa, Haemobartonella felis
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYILNPEGQWTPDLSKKHWSCNKPDYQKNGDCSYYRIGSAAKTRREILQELLTNGKKPKDIEKLQKGNDGIEETDKSFERNKDQYSVAPIEPGSLQSRSRSHLLKFEYGDDHQNLGAQLRTLDNKIGSRKIENRNYQVNYNFNNNSYLDLNLMAAHNIGKTIYPKGGFFAGWQVADKLITKNVANIVDINNSHTFLLPKEIDLKTTLGFNYFTNEYSKNRFPEELSLFYNDASHDQGLYSHSKRGRYSGTKSLLPQRSVILQPSGKQKFKTVYFDTALSKGIYHLNYSVNFTHYAFNGEYVGYENTAGQQINEPILHKSGHKKAFNHSATLSAELSDYFMPFFTYSRTHRMPNIQEMFFSQVSNAGVNTALKPEQSDTYQLGFNTYKKGLFTQDDVLGVKLVGYRSFIKNYIHNVYGVWWRDGMPTWAESNGFKYTIAHQNYKPIVKKSGVELEINYDMGRFFANVSYAYQRTNQPTNYADASPRPNNASQEDILKQGYGLSRVSMLPKDYGRLELGTRWFDQKLTLGLAARYYGKSKRATIEEEYINGSRFKKNTLRRENYYAVKKTEDIKKQPIILDLHVSYEPIKDLIIKAEVQNLLDKRYVDPLDAGNDAASQRYYSSLNNSIECAQDSSACGGSDKTVLYNFARGRTYILSLNYKF

SEQ ID NO: 1168 - DNA, 36 bp, Artificial Sequence; identical to SEQ ID NO: 1098
  Description of Artificial Sequence:  Novel Sequence

The invention claimed is:

1. An isolated or recombinant polypeptide comprising:
(a) the amino acid sequence of SEQ ID NO: 650; or
(b) an amino acid sequence having 90% or greater sequence identity to (a).

2. The polypeptide of claim 1 comprising the amino acid sequence of SEQ ID NO: 650.

3. A composition comprising the protein of claims 1 or 2 and an adjuvant.

* * * * *